US008637036B2

(12) United States Patent
Mascola et al.

(10) Patent No.: US 8,637,036 B2
(45) Date of Patent: Jan. 28, 2014

(54) NEUTRALIZING ANTIBODIES TO HIV-1 AND THEIR USE

(75) Inventors: John R. Mascola, Rockville, MD (US); Richard T. Wyatt, San Diego, CA (US); Xueling Wu, Potomac, MD (US); Yuxing Li, Boyds, MD (US); Carl-Magnus Hogerkorp, Vellinge (SE); Mario Roederer, Washington, DC (US); Zhi-yong Yang, Potomac, MD (US); Gary J. Nabel, Washington, DC (US); Peter D. Kwong, Washington, DC (US); Tongqing Zhou, Boyds, MD (US); Mark Connors, Bethesda, MD (US); William R. Schief, Encinitas, CA (US)

(73) Assignees: The United States of America, as represented by the Secretary, Department of Health and Human Services, Washington, DC (US); University of Washington, Seattle, WA (US)

( * ) Notice: Subject to any disclaimer, the term of this patent is extended or adjusted under 35 U.S.C. 154(b) by 0 days.

(21) Appl. No.: 13/429,286

(22) Filed: Mar. 23, 2012

(65) Prior Publication Data

US 2012/0237523 A1    Sep. 20, 2012

Related U.S. Application Data

(63) Continuation of application No. PCT/US2010/050295, filed on Sep. 24, 2010.

(60) Provisional application No. 61/385,531, filed on Sep. 22, 2010, provisional application No. 61/402,314, filed on Aug. 27, 2010, provisional application No. 61/346,808, filed on May 20, 2010, provisional application No. 61/290,135, filed on Dec. 24, 2009, provisional application No. 61/252,613, filed on Oct. 16, 2009, provisional application No. 61/246,039, filed on Sep. 25, 2009.

(51) Int. Cl.
*A61K 39/42*   (2006.01)
*A61K 39/21*   (2006.01)
*C12Q 1/70*    (2006.01)

(52) U.S. Cl.
USPC .......................... 424/160.1; 424/208.1; 435/5

(58) Field of Classification Search
USPC ....................................................... 424/142
See application file for complete search history.

(56) References Cited

U.S. PATENT DOCUMENTS

| 6,117,655 A | 9/2000 | Capon et al. |
| 2005/0220817 A1 | 10/2005 | Sodroski et al. |

FOREIGN PATENT DOCUMENTS

| WO | WO/99/24065 | 5/1999 |
| WO | WO/2005/034992 | 4/2005 |
| WO | WO/2006/074071 | 7/2006 |
| WO | WO/2006/091455 | 8/2006 |
| WO | WO/2007/030518 | 3/2007 |
| WO | WO/2007/030637 | 3/2007 |
| WO | WO/2008/025015 | 2/2008 |
| WO | WO/2009/100376 | 8/2009 |

OTHER PUBLICATIONS

Li et al., Broad HIV-1 neutralization mediated by CD4-binding site antibodies, Nature medicine, 2007. 13(9): pp. 1032-1034.*
Wu et al., Enhanced Exposure of the CD4-Binding Site to Neutralizing Antibodies by Structural Design of a Membrane-Anchored Human Immunodeficiency Virus Type 1 gp 120 Domain, 2009, Journal of Virology, 83(10): 5077-5086.*
Anderson et al., "Testing the hypothesis of a recombinant origin of human immunodeficiency virus type 1 subtype E," J. Virol., 74:10752-10765, 2000.
Bell et al., "Structure of antibody F425-B4e8 in complex with a V3 peptide reveals a new binding mode for HIV-1 neutralization," J. Molecular Biol., 375:969-978, 2008.
Binley et al., "Comprehensive cross-clade neutralization analysis of a panel of anti-human immunodeficiency virus type 1 monoclonal antibodies," J. Virol., 78:13232-13252, 2004.
Binley et al., "Profiling the specificity of neutralizing antibodies in a large panel of plasmas from patients chronically infected with human immunodeficiency virus type 1 subtypes B and C," J. Virol., 82:11651-11668, 2008.
Burton et al., "Efficient neutralization of primary isolates of HIV-1 by a recombinant human monoclonal antibody," Science, 266:1024-1027, 1994.
Burton, "Antibodies, viruses and vaccines," Nat. Rev. Immunol., 2:706-713, 2002.
Burton et al., "HIV vaccine design and the neutralizing antibody problem," Nat. Immunol., 5:233-236, 2004.
Chen et al., "Structure of an unliganded simian immunodeficiency virus gp120 core," Nature, 433:834-841, 2005.
Corti et al., "Analysis of memory B cell responses and isolation of novel monoclonal antibodies with neutralizing breadth from HIV-1-infected individuals," PLoS One, 5:e8805, 2010 (15 pages).
Decker et al., "Antigenic conservation and immunogenicity of the HIV coreceptor binding site," J. Exp. Med., 201:1407-1419, 2005.
Deeks et al., "Neutralizing antibody responses against autologous and heterologous viruses in acute versus chronic human immunodeficiency virus (HIV) infection: evidence for a constraint on the ability of HIV to completely evade neutralizing antibody responses," J. Virol., 80:6155-6164, 2006.
Dey et al., "Characterization of human immunodeficiency virus type 1 monomeric and trimeric gp120 glycoproteins stabilized in the CD4-bound state: antigenicity, biophysics, and immunogenicity," J. Virol., 81:5579-5593, 2007.
Dey et al., "Structure-based stabilization of HIV-1 gp120 enhances humoral immune responses to the induced co-receptor binding site," PLoS Pathog., 5:e1000445, 2009 (15 pages).
Dhillon et al., "Dissecting the neutralizing antibody specificities of broadly neutralizing sera from human immunodeficiency virus type 1-infected donors," J. Virol., 81:6548-6562, 2007.

(Continued)

*Primary Examiner* — Stacy B. Chen
*Assistant Examiner* — Barry A Chestnut
(74) *Attorney, Agent, or Firm* — Klarquist Sparkman, LLP

(57) ABSTRACT

Monoclonal neutralizing antibodies are disclosed that specifically bind to the CD4 binding site of HIV-1 gp120. Monoclonal neutralizing antibodies also are disclosed that specifically bind to HIV-1 gp41. The identification of these antibodies, and the use of these antibodies are also disclosed. Methods are also provided for enhancing the binding and neutralizing activity of any antibody using epitope scaffold probes.

23 Claims, 132 Drawing Sheets

(56) References Cited

OTHER PUBLICATIONS

Dimitrov, "Antibody therapeutics, vaccines and antibodyomes," mAbs, 2:347-356, 2010.

Diskin et al., "Structure of a Glade C HIV-1 gp120 bound to CD4 and CD4-induced antibody reveals anti-CD4 polyreactivity," Nat. Struct. Mol. Biol., 17:608-613, 2010.

Doria-Rose, et al, "Frequency and phenotype of human immunodeficiency virus envelope-specific B cells from patients with broadly cross-neutralizing antibodies," J. Virol., 83:188-199, 2009.

Doria-Rose et al., "Breadth of human immunodeficiency virus-specific neutralizing activity in sera: clustering analysis and association with clinical Variables," J. Virol., 84:1631-1636, 2010.

Finzi et al., "Topological layers in the HIV-1 gp120 inner domain regulate gp41 nteraction and CD4-triggered conformational transitions," Mol. Cell. 37:656-676, 2010.

Forsman et al., "Llama antibody fragments with cross-subtype human immunodeficiency virus type 1 (HIV-1)-neutralizing properties and high affinity for HIV-1 gp120," J. Virol., 82:12069-12081, 2008.

Gnanakaran et al., "Genetic signatures in the envelope glycoproteins of HIV-1 that associate with broadly neutralizing antibodies," PLoS Comput. Biol., 6:e1000955, 2010 (26 pages).

Gray et al., "Antibody specificities associated with neutralization breadth in plasma from human immunodeficiency virus type 1 subtype C-infected blood donors," J. Virol., 83:8925-8937, 2009.

Haim et al., "Soluble CD4 and CD4-mimetic compounds inhibit HIV-1 infection by induction of a short-lived activated state," PLoS Pathog., 5:e1000360, 2009 (13 pages).

Huang et al., "Structural basis of tyrosine sulfation and VH-gene usage in antibodies that recognize the HIV type 1coreceptor-binding site on gp120," Proc. Natl. Acad. Sci. U.S.A., 101:2706-2711, 2004.

Huang et al., "Structure of a V3-Containing HIV-1 gp120 Core," Science, 310:1025-1028, 2005.

Huang et al., "Structures of the CCR5 N Terminus and of a Tyrosine-Sulfated Antibody with HIV-1 gp120 and CD4," Science, 317:1930-1934, 2007.

Kassa et al., "Transitions to and from the CD4-Bound Conformation Are Modulated by a Single-Residue Change in the Human Immunodeficiency Virus Type 1 gp120 Inner Domain," J. Virol., 83:8364-8378, 2009.

Keele et al., "Identification and characterization of transmitted and early founder virus envelopes in primary HIV-1 infection," Proc. Natl. Acad. Sci. U.S.A., 105:7552-7557, 2008.

Korber et al., "The implications of patterns in HIV diversity for neutralizing antibody induction and susceptibility," Curr. Opin. HIV AIDS, 4:408-417, 2009.

Kwong et al., "Structure of an HIV gp120 envelope glycoprotein in complex with the CD4 receptor and a neutralizing human antibody," Nature, 393:648-659, 1998.

Kwong et al., "Structure of HIV gp120 envelope glycoproteins from laboratory-adapted and primary," Structure, 8:1329-1339, 2000.

Kwong et al., "HIV-1 evades antibody-mediated neutralization through conformational masking of receptor-binding sites," Nature, 420:678-682, 2002.

Li et al., "Human Immunodeficiency Virus Type 1 env Clones from Acute and Early Subtype B Infections for Standardized Assessments of Vaccine-Elicited Neutralizing Antibodies," J. Virol., 79:10108-10125, 2005.

Li et al., "Genetic and Neutralization Properties of Subtype C Human Immunodeficiency Virus Type 1 Molecular env Clones from Acute and Early Heterosexually Acquired Infections in Southern Africa," J. Virol., 80:11776-11790, 2006.

Li et al., "Analysis of neutralization specificities in polyclonal sera derived from human immunodeficiency virus type 1-infected individuals," J. Virol., 83:1045-1059, 2009.

Li et al., "Mechanism of neutralization by the broadly neutralizing HIV-1 monoclonal antibody VRC01," J. Virol., 85:8954-8967, 2011.

Longo et al., "Analysis of somatic hypermutation in X-linked hyper-IgM syndrome shows specific deficiencies in mutational targeting," Blood, 113:3706-3715, 2009.

Madani et al., "Small-molecule CD4 mimics interact with a highly conserved pocket on HIV-1 gp120," Structure, 16:1689-1701, 2008.

Martin et al., "Rational design of a CD4 mimic that inhibits HIV-1 entry and exposes cryptic neutralization epitopes," Nat. Biotechnol., 21:71-76, 2003.

Mascola et al., "Human immunodeficiency virus type 1 neutralization measured by flow cytometric quantitation of single-round infection of primary human T cells," J. Virol., 76:4810-4821, 2002.

Mascola et al., "The role of antibodies in HIV vaccines.," Ann. Rev. Immunol., 28:413-444, 2010.

Montefiori et al., "Neutralizing and other antiviral antibodies in HIV-1 infection and vaccination," Curr. Opin. HIV AIDS, 2:169-176, 2007.

Moore et al., "Antibody cross-competition analysis of the human immunodeficiency virus type 1 gp120 exterior envelope glycoprotein," J. Virol., 70:1863-1872, 1996.

Myszka et al., "Energetics of the HIV gp120-CD4 binding reaction," Proc. Natl. Acad. Sci. U.S.A., 97:9026-9031, 2000.

Pantophlet et al., "GP120: target for neutralizing HIV-1 antibodies," Ann. Rev. Immunol., 24:739-769, 2006.

Prabakaran et al., "Structure of severe acute respiratory syndrome coronavirus receptor-binding domain complexed with neutralizing antibody," J. Biol. Chem., 281:15829-15836, 2006.

Richman et al., "Rapid evolution of the neutralizing antibody response to HIV type 1 infection," Proc. Natl. Acad. Sci. U.S.A., 100:4144-4149, 2003.

Rits-Volloch et al., "Restraining the conformation of HIV-1 gp120 by removing a flexible loop," EMBO J., 25:5026-5035, 2006.

Rossmann, "The canyon hypothesis: Hiding the host cell receptor attachment site on a viral surface from immune surveillance," J. Biol. Chem., 264:14587-14590, 1989.

Sakihama et al., "Oligomerization of CD4 is required for stable binding to class II major histocompatibility complex proteins but not for interaction with human immunodeficiency virus gp120," Proc. Natl. Acad. Sci. U.S.A., 92:6444-6448, 1995.

Sather et al., "Factors associated with the development of cross-reactive neutralizing antibodies during human immunodeficiency virus type 1 infection," J. Virol., 83:757-769, 2009.

Schied et al., "A method for identification of HIV gp140 binding memory B cells in human blood," J. Immunol. Methods, 343:65-67, 2009.

Scheid et al., "Broad diversity of neutralizing antibodies isolated from memory B cells in HIV-infected individuals," Nature, 458:636-640, 2009.

Seaman et al., "Tiered categorization of a diverse panel of HIV-1 Env pseudoviruses for assessment of neutralizing antibodies," J. Virol., 84:1439-1452, 2010.

Shu et al., "Efficient protein boosting after plasmid DNA or recombinant adenovirus immunization with HIV-1 vaccine constructs," Vaccine, 25:1398-1408, 2007.

Simek et al., "Human immunodeficiency virus type 1 elite neutralizers: Individuals with broad and potent neutralizing activity identified by using a high-throughput neutralization assay together with an analytical selection algorithm," J. Virol., 83:7337-7348, 2009.

Smith et al., "Lack of neutralizing antibody response to HIV-1 predisposes to superinfection," Virology, 355:1-5, 2006.

Stamatatos et al., "Neutralizing antibodies generated during natural HIV-1 infection: good news for an HIV-1 vaccine?," Nat. Med., 15:866-870, 2009.

Thomson et al., "Germline V-genes sculpt the binding site of a family of antibodies neutralizing human cytomegalovirus," EMBO J., 27:2592-2602, 2008.

Tiller et al., "Efficient generation of monoclonal antibodies from single human B cells by single cell RT-PCR and expression vector cloning," J. Immunol. Methods., 329:112-124, 2008.

Walker et al., "Broad and potent neutralizing antibodies from an African donor reveal a new HIV-1 vaccine target," Science, 326:285-289, 2009.

Wardemann et al., "Predominant autoantibody production by early human B cell precursors," Science, 301:1374-1377, 2003.

Wrammert et al., "Rapid cloning of high-affinity human monoclonal antibodies against influenza virus," Nature, 453:667-671, 2008.

(56) References Cited

OTHER PUBLICATIONS

Wu et al., "Soluble CD4 broadens neutralization of V3-directed monoclonal antibodies and guinea pig vaccine sera against HIV-1 subtype B and C reference viruses," Virology, 380:285-295, 2008.

Wu et al., "Rational design of envelope identifies broadly neutralizing antibodies to HIV-1," Science, 329:856-861, 2010.

Wu et al., "Focused evolution of HIV-1 neutralizing antibodies revealed by structures and deep sequencing," Science, 333:1593-1602, 2011.

Wyatt et al., "The antigenic structure of the HIV gp120 envelope glycoprotein," Nature, 393:705-711, 1998.

Xiang et al., "Mutagenic Stabilization and/or Disruption of a CD4-Bound State Reveals Distinct Conformations of the Human Immunodeficiency Virus Type 1 gp120 Envelope Glycoprotein," J. Virol., 76:9888-9899, 2002.

Xiao et al., "Germline-like predecessors of broadly neutralizing antibodies lack measurable binding to HIV-1 envelope glycoproteins: implications for evasion of immune response and design of vaccine immunogens," Biochem. Biophys. Res. Commun., 390:404-409, 2009.

Xiao et al., "Maturation pathways of cross-reactive HIV-1, Neutralizing Antibodies," Viruses, 1:802-817, 2009.

Zhou et al., "Structural definition of a conserved neutralization epitope on HIV-1 33gp120," Nature, 445:732-737, 2007.

Zolla-Pazner, "Identifying epitopes of HIV-1 that induce protective antibodies," Nat. Rev. Immunol., 4:199-210, 2004.

Chen et al., "Structural basis of immune evasion at the site of CD4 attachment on HIV-1 gp120," Science, 326:5956, pp. 1123-1127, Nov. 2009.

International Search Report issued by the European Patent Office on May 13, 2010 in related parent application PCT/US2010/050295 (8 pages).

Li et al., "Broad HIV-1 neutralization mediated by CD4-binding site antibodies," Nature Medicine, 13:9, pp. 1032-1034, Sep. 2007.

Written Opinion issued by the European Patent Office on May 13, 2010 in related parent application PCT/US2010/050295 (9 pages).

Wu et al., "Enhanced exposure of the CD4-binding site to neutralizing antibodies by structural design of a membrane-anchored human immunodeficiency virus type 1 gp120 domain," Journal of Virology, 83:10, pp. 5077-5086, May 2009.

Wu et al., "Mechanism of human immunodeficiency virus type 1 resistance to monoclonal antibody B12 that effectively targets the site of CD4 attachment," Journal of Virology, 83:21, pp. 10892-10907, Nov. 2009.

Zhou et al., "Structural basis for broad and potent neutralization of HIV-1 by antibody VRC01," Science, 329:5993, pp. 811-817, Aug. 2010.

Al-Lazikani et al., "Standard Conformations for the Canonical Structures of Immunoglobulins", J. Mol. Biol., 273:927-948, 1997.

Kwong and Mascola, "Human Antibodies that Neutralize HIV-1: Identification, Structures, and B Cell Ontogenies," Immunity, 37:412-425, 2012.

Lefranc et al., "IMGT Unique Numbering for Immunoglobulin and T Cell Receptor Variable Domains and Ig Superfamily V-like Domains," Dev. Comp. Immunol., 27:55-77, 2003.

Prabakaran et al., "Structural Mimicry of CD4 by a Cross-reactive HIV-1 Neutralizing Antibody with CDR-H2 and H3 Containing Unique Motifs," J. Mol. Biol., 357:82-89, 2006.

Sanders et al., "The Mannose-Dependent Epitope for Neutralizing Antibody 2G12 on Human Immunodeficiency Virus Type 1 Glycoprotein gp120," J. Virol., 76:7293-7305, 2002.

* cited by examiner

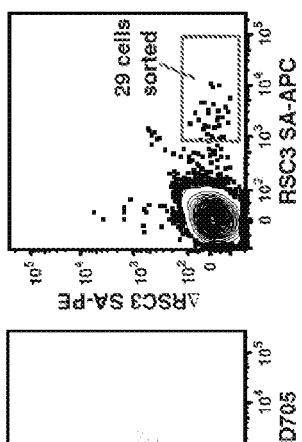
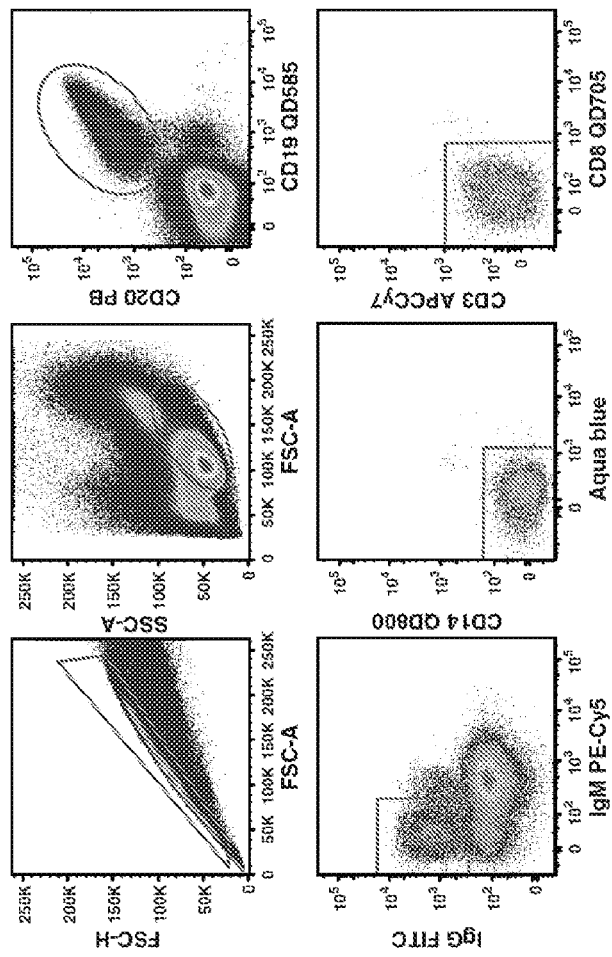
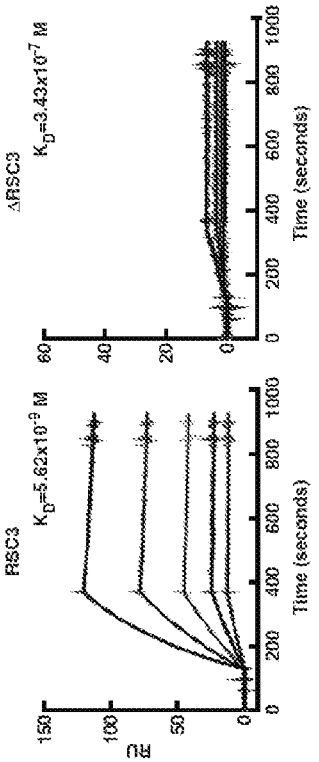
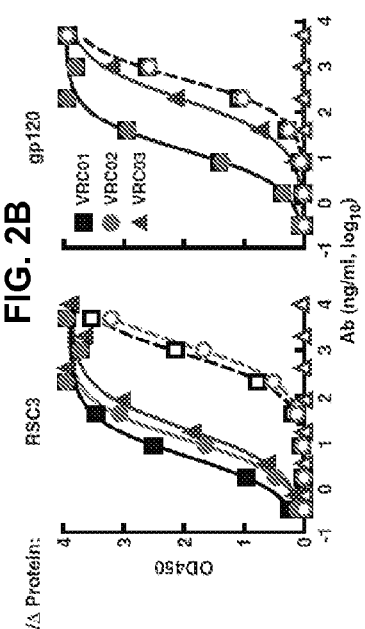
FIG. 2A
FIG. 2B
FIG. 2C

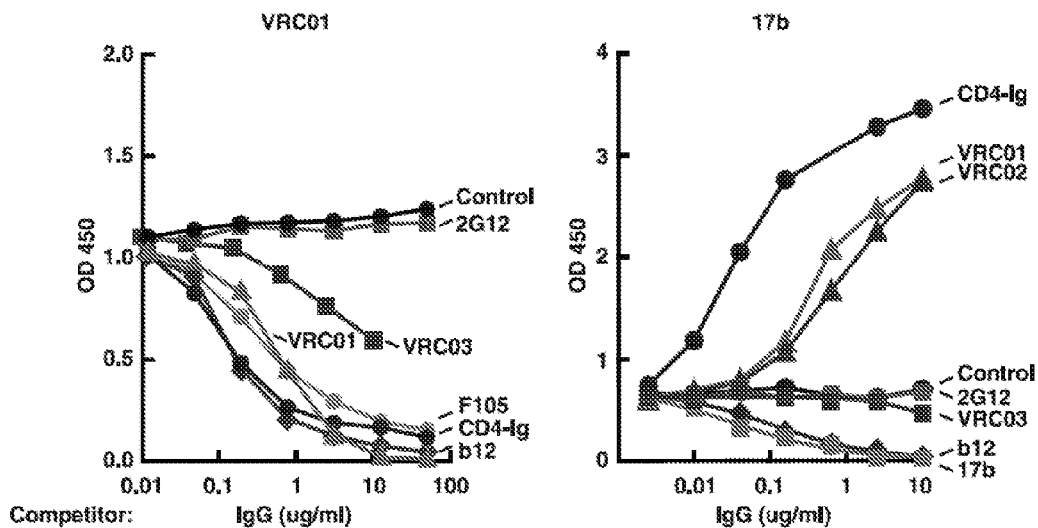
FIG. 3A
FIG. 3B
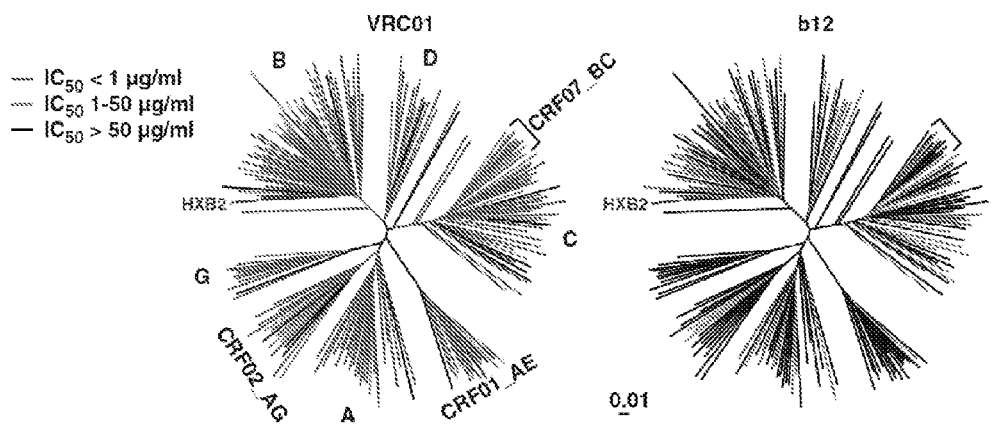
FIG. 4

FIG. 5A

```
┌─────────────────────────────────────────────────────────────┐
│  Determination of antibody contact ──── Computation of      │
│  residues on wild type protein         surface accessibility│
└─────────────────────────────────────────────────────────────┘
                            │
                            ▼
              Yes      ◇ Antibody ◇      No
          ┌───────────  contact?  ───────────┐
          │             ◇        ◇           │
          │                                  ▼
          │          No    ◇ Surface    ◇  Yes
          │         ┌──── Accessible? ────┐
          │         │      ◇        ◇     │
          │         ▼                     ▼
          │    ┌─────────────┐    Yes  ◇ Within     ◇  No
          │    │ Keep native │◁──────  ◇ glycan    ◇────┐
          └───▶│ amino acid  │         ◇  fence?    ◇   │
               └─────────────┘                          ▼
                                              ┌──────────────┐
                                              │  Candidate   │
                                              │  Resurfacing │
                                              │  Positions   │
                                              └──────────────┘
                                                      │
        ┌──────────────────────────┐                  │
        │ Evolutionary Information │──┐               │
        └──────────────────────────┘  │               ▼
        ┌──────────────────────────┐  │     ┌────────────────────┐
        │Structural & Solubility   │──┼────▶│ Allowed amino acids│
        │     Considerations       │  │     │at each resurfacing │
        └──────────────────────────┘  │     │     position       │
        ┌──────────────────────────┐  │     └────────────────────┘
        │Enforce similarities or   │──┘               │
        │differences with wild type│                  ▼
        │or pre-existing designs   │        ┌────────────────────┐
        └──────────────────────────┘        │  Energy-based design│
                                            │  of resurfaced gp120│
                                            │    (RosettaDesign)  │
                                            └────────────────────┘
                                                      │
                                                      ▼
                                            ┌────────────────────┐
                                            │Experimental        │
                                            │evaluation          │
                                            └────────────────────┘
```

FIG. 6

| Name | Model | Percent Resurfaced | Antigenicity | | |
|---|---|---|---|---|---|
| | | | CD4-Ig | b12 | 2G12 |
| RC0 | | 0 | +++ | +++ | +++ |
| ΔRC0 | | | — | — | +++ |
| RC1 | | 12.7 | + | +++ | +++ |
| ΔRC1 | | | — | — | +++ |
| RSC2 | | 17.2 | — | +++ | +++ |
| ΔRSC2 | | | | — | +++ |
| RSC3 | | 31.3 | — | +++ | +++ |
| ΔRSC3 | | | — | — | +++ |
| RC4 | | 24.6 | | — | — |
| ΔRC4 | | | | — | + |
| RC5 | | 25.4 | — | ++ | + |
| ΔRC5 | | | — | — | — |
| RC6 | | 26.0 | — | ++ | + |
| ΔRC6 | | | — | — | — |
| RC7 | | 31.5 | | — | — |
| ΔRC7 | | | | — | — |
| RC8 | | 29.3 | — | ++ | — |
| ΔRC8 | | | — | — | — |

FIG. 7

| Sample ID | Neutralization (ID₅₀) | | | | | | ELISA Binding | |
|---|---|---|---|---|---|---|---|---|
| | JRFL (B) | PVO.4 (B) | YU2 (B) | RW020.2 (A) | ZA012.29 (C) | MutV | RSC3 | ΔRSC3 |
| 45 | 4634 | 172 | 767 | 207 | 301 | 26 | +++ | + |
| N6 | 2092 | 245 | 210 | 865 | 205 | 31 | +++ | - |
| N27 | 558 | 126 | 93 | 2121 | 53 | 39 | +++ | - |
| N44 | 408 | 49 | 24 | 17 | 268 | 37 | +++ | - |
| N32 | 1250 | 1940 | 55 | 2688 | 150 | 44 | +++ | + |
| 200-384 | 2458 | 949 | 341 | 582 | 120 | <5 | +++ | + |
| 44 | 6121 | 182 | 217 | 237 | 89 | 18 | +++ | ++ |
| N17 | 810 | 617 | 134 | 566 | 290 | 20 | +++ | +++ |
| 1 | 650 | 60 | 139 | 280 | 78 | 27 | ++ | + |
| N22 | 2702 | 87 | 211 | 374 | 160 | 13 | ++ | ++ |
| 20 | 231 | 113 | 42 | 34 | 47 | 19 | + | - |
| N95 | 593 | 32 | 409 | 165 | 19 | 34 | +++ | - |
| N55 | 2601 | 624 | 96 | 3072 | 105 | 16 | +++ | ++ |
| N26 | 3655 | 2675 | 309 | 173 | 100 | <5 | ++ | ++ |
| N53 | 2225 | 1714 | 1152 | 1258 | 125 | 34 | + | + |

FIG. 10A

| Heavy chain | IGHV | IGHD | IGHJ | CDR3 length (amino acid) | VH mutation frequency |
|---|---|---|---|---|---|
| VRC01 | 1-02*02 | 3-16*01 (or *02) | 1*01^b | 14 | 91/288 (32%) |
| VRC02 | 1-02*02 | 3-16*01 (or *02) | 1*01^b | 14 | 92/288 (32%) |
| VRC03 | 1-02*02 | IGHD3 family^a | 1*01 | 16 | 86/288 (30%) |
| b12 | 1-03*01 | 3-10*02 | 6*03 | 20 | 39/288 (13%) |
| Normal donors | | | | 15 | 5.9% |

| Light chain | IGKV | | | IGKJ | CDR3 length (amino acid) | VK mutation frequency |
|---|---|---|---|---|---|---|
| VRC01 | 3-11*01^c | | | 2*01 | 5 | 45/264 (17%) |
| VRC02 | 3-11*01^c | | | 2*01 | 5 | 49/264 (19%) |
| VRC03 | 3-20*01^d | | | 2*01 | 5 | 53/267 (20%) |
| b12 | 3-20*01 | | | 2*01 | 9 | 35/267 (13%) |
| Normal donors | | | | | 9 | 2.0% |

FIG. 10B

FIG. 12A
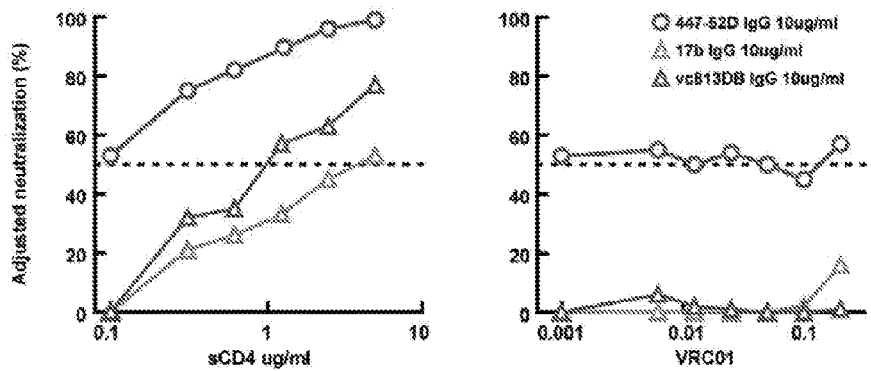
FIG. 12B
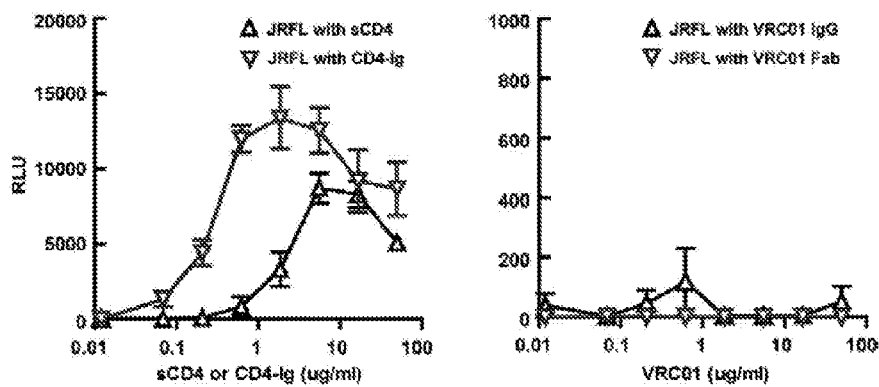
FIG. 13A
| | VRC01 sensitive | VRC01 resistant | Total |
|---|---|---|---|
| Serum 45 IgG sensitive | 122 | 8 | 130 |
| Serum 45 IgG resistant | 6 | 4 | 10 |
| Total | 128 | 12 | 140 |
P=0.005 by Fisher's exact test
FIG. 13B
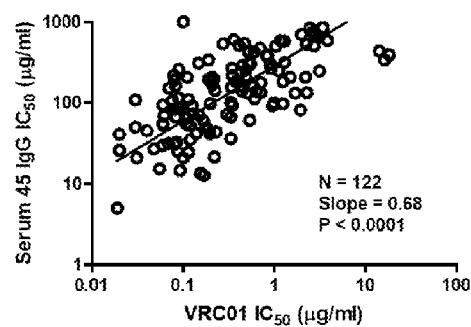

FIG. 14

Table S1. ELISA binding profiles of VRC01, VRC02 and VRC03 compared to a panel of known mAbs

| | | YU2 gp120 based mutants* | | | | | | HXB2 core proteins | | Antigenically resurfaced proteins | | |
|---|---|---|---|---|---|---|---|---|---|---|---|---|
| | | gp120 WT | gp120 D368R | gp120 I420R | gp120 K121D | gp120 D368R/ I420R | gp120 M475S/ R476A | gp120 core | stabilized core | RSC3 | ΔRSC3 (Δ371I) | ΔRSC3** (P363N Δ371I) |
| CD4bs | CD4-Ig | ++++# | - | ++++ | ++++ | - | - | + | -+++ | - | - | - |
| | VRC01 | ++++ | +++ | ++++ | ++++ | +++ | +++ | ++++ | -+++ | ++++ | ++ | + |
| | VRC02 | ++++ | +++ | ++++ | ++++ | +++ | +++ | ++++ | -+++ | ++++ | ++ | + |
| | VRC03 | +++ | - | ++ | +++ | - | - | +++ | -+++ | ++++ | - | - |
| | b12 | ++++ | - | ++++ | ++++ | - | ++ | ++++ | -+++ | ++++ | - | - |
| | b13 | ++++ | - | ++++ | ++++ | + | ++++ | ++++ | -+++ | ++++ | - | - |
| | m18 | ++++ | + | ++++ | ++++ | + | ++ | ++++ | -+++ | ++++ | - | - |
| | b6 | ++++ | ++++ | ++++ | ++++ | ++++ | - | ++++ | + | - | - | - |
| | 1.5E | ++++ | ++++ | ++++ | ++++ | ++++ | + | ++++ | - | - | - | - |
| | F91 | ++++ | - | ++++ | ++++ | - | - | ++++ | - | - | - | - |
| | F105 | ++++ | - | ++++ | ++++ | - | - | ++++ | - | - | - | - |
| Co-receptor | 17b | ++++ | ++++ | - | + | + | - | - | - | - | - | - |
| | 48D | +++ | ++++ | - | - | - | - | - | - | - | - | - |
| | E51 | ++++ | ++++ | - | - | + | - | - | - | - | - | - |
| V3 | 447-52D | ++++ | ++++ | ++++ | ++++ | ++++ | ++++ | - | - | - | - | - |
| | 39F | ++++ | ++++ | ++++ | ++++ | ++++ | ++++ | - | - | - | - | - |
| Constant regions | 2.2C | ++++ | ++++ | ++ | +++ | ++ | + | - | - | - | - | - |
| | 211C | +++ | +++ | + | + | + | - | - | - | - | - | - |
| Other | 2G12 | ++ | + | + | + | + | + | +++ | ++++ | +++ | +++ | ++ |
| | HIVIG | +++ | +++ | +++ | +++ | +++ | +++ | +++ | +++ | +++ | ++ | + |
| | 2F5 | - | - | - | - | - | - | - | - | - | - | - |

*Mutant residue numbers are based on the HXB2 sequence.
** This is a double mutant of the Δ371I deletion together with the P363N mutation, which adds an N-linked glycan on the β15 strand near the CD4 binding loop
Binding was categorized based on the OD450 values at the highest concentration of antibody tested (5 ug/ml for mAbs and CD4-Ig, 50 µg/ml for HIVIG) and the 50% effective concentration ($EC_{50}$) values as shown below:
++++   $OD_{450} \geq 3.0$ and $EC_{50} \leq 0.1$
+++    $OD_{450} \geq 3.0$ and $EC_{50} > 0.1$
++     $1.0 \leq OD_{450} < 3.0$
+      $0.2 \leq OD_{450} < 1.0$
-      $OD_{450} < 0.2$

FIG. 15

Table S2a: Summary of the breadth and potency of antibody neutralization against 190 HIV-1 Env-pseudoviruses

| Clade | | Measured by IC$_{50}$ (µg/ml) | | | | | Measured by IC$_{80}$ (µg/ml) | | | | |
|---|---|---|---|---|---|---|---|---|---|---|---|
| | | VRC01 | VRC02 | VRC03 | b12 | CD4-Ig | VRC01 | VRC02 | VRC03 | b12 | CD4-Ig |
| Total | Titer < 50 | 91% | 91% | 57% | 41% | 94% | 86% | 88% | 48% | 27% | 86% |
| (N = 190) | Titer < 1 | 72% | 75% | 39% | 17% | 30% | 42% | 44% | 26% | 5% | 8% |
| | Median* | 0.37 | 0.38 | 9.76 | >50 | 3.35 | 1.44 | 1.37 | >50 | >50 | 20.50 |
| | Geometric mean* | 0.34 | 0.32 | 0.45 | 1.79 | 2.39 | 1.03 | 1.04 | 0.94 | 3.83 | 6.44 |
| A | Titer < 50 | 100% | 100% | 64% | 45% | 91% | 95% | 95% | 55% | 27% | 55% |
| (N = 22) | Titer < 1 | 95% | 95% | 45% | 23% | 32% | 77% | 82% | 23% | 5% | 14% |
| | Median* | 0.11 | 0.10 | 2.47 | >50 | 8.30 | 0.50 | 0.39 | 19.5 | >50 | 43.50 |
| | Geometric mean* | 0.15 | 0.13 | 0.46 | 1.29 | 2.66 | 0.45 | 0.40 | 0.97 | 2.67 | 5.46 |
| B | Titer < 50 | 96% | 94% | 80% | 63% | 96% | 94% | 94% | 76% | 55% | 63% |
| (N = 49) | Titer < 1 | 80% | 82% | 65% | 39% | 35% | 39% | 41% | 49% | 10% | 12% |
| | Median* | 0.39 | 0.44 | 0.29 | 1.80 | 2.49 | 1.67 | 1.46 | 1.11 | 19.10 | 15.88 |
| | Geometric mean* | 0.39 | 0.36 | 0.25 | 0.75 | 1.99 | 1.28 | 1.25 | 0.81 | 3.48 | 4.43 |
| C | Titer < 50 | 87% | 87% | 58% | 47% | 95% | 82% | 79% | 42% | 26% | 68% |
| (N = 38) | Titer < 1 | 68% | 71% | 29% | 13% | 39% | 37% | 39% | 16% | 0% | 8% |
| | Median* | 0.39 | 0.40 | 26.70 | >50 | 1.42 | 1.50 | 1.39 | >50 | >50 | 18.85 |
| | Geometric mean* | 0.34 | 0.35 | 1.07 | 4.46 | 1.40 | 1.14 | 0.93 | 1.69 | 7.25 | 6.17 |
| D | Titer < 50 | 88% | 88% | 25% | 63% | 100% | 75% | 88% | 13% | 50% | 88% |
| (N = 8) | Titer < 1 | 50% | 63% | 13% | 25% | 38% | 25% | 25% | 13% | 13% | 25% |
| | Median* | 1.37 | 0.72 | >50 | 10.25 | 1.82 | 3.91 | 5.11 | >50 | >50 | 6.93 |
| | Geometric mean* | 0.73 | 0.68 | 1.40 | 0.91 | 1.10 | 1.83 | 2.78 | 0.19 | 1.93 | 2.76 |
| CRF01_AE | Titer < 50 | 89% | 89% | 28% | 6% | 78% | 83% | 89% | 22% | 0% | 56% |
| (N = 18) | Titer < 1 | 61% | 61% | 11% | 0% | 22% | 17% | 22% | 6% | 0% | 0% |
| | Median* | 0.44 | 0.50 | >50 | >50 | 10.80 | 1.72 | 2.06 | >50 | >50 | 35.29 |
| | Geometric mean* | 0.61 | 0.56 | 2.01 | 41.2 | 4.89 | 1.77 | 2.15 | 5.67 | >50 | 14.45 |
| CRF02_AG | Titer < 50 | 81% | 81% | 19% | 19% | 100% | 75% | 81% | 19% | 6% | 75% |
| (N = 16) | Titer < 1 | 56% | 56% | 19% | 0% | 25% | 38% | 38% | 13% | 0% | 6% |
| | Median* | 0.59 | 0.59 | >50 | >50 | 2.82 | 2.20 | 1.92 | >50 | >50 | 25.09 |
| | Geometric mean* | 0.35 | 0.35 | 0.06 | 8.04 | 2.28 | 0.95 | 1.18 | 0.47 | 42.73 | 7.96 |
| G | Titer < 50 | 90% | 90% | 60% | 0% | 100% | 90% | 90% | 40% | 0% | 60% |
| (N = 10) | Titer < 1 | 90% | 90% | 30% | 0% | 20% | 50% | 50% | 20% | 0% | 0% |
| | Median* | 0.34 | 0.42 | 24.91 | >50 | 7.44 | 1.00 | 1.12 | >50 | >50 | 24.61 |
| | Geometric mean* | 0.25 | 0.29 | 1.14 | >50 | 5.14 | 0.88 | 0.89 | 0.91 | >50 | 7.10 |
| CRF07_BC | Titer < 50 | 100% | 100% | 73% | 27% | 100% | 91% | 91% | 45% | 18% | 91% |
| (N = 11) | Titer < 1 | 45% | 55% | 45% | 9% | 36% | 18% | 27% | 18% | 9% | 0% |
| | Median* | 1.25 | 0.95 | 1.47 | >50 | 1.20 | 3.53 | 3.54 | >50 | >50 | 7.52 |
| | Geometric mean* | 1.23 | 0.96 | 0.74 | 2.57 | 1.95 | 3.05 | 2.39 | 0.83 | 2.32 | 7.63 |
| Other recombinants | Titer < 50 | 83% | 83% | 56% | 33% | 94% | 78% | 83% | 50% | 11% | 67% |
| (N = 18) | Titer < 1 | 78% | 83% | 44% | 6% | 6% | 61% | 61% | 33% | 6% | 0% |
| | Median* | 0.13 | 0.12 | 8.33 | >50 | 7.87 | 0.41 | 0.46 | >50 | >50 | 25.67 |
| | Geometric mean* | 0.12 | 0.13 | 0.20 | 6.99 | 6.56 | 0.33 | 0.44 | 0.43 | 3.25 | 13.12 |

*Medians were calculated using 100 for any IC$_{50}$ (or IC$_{80}$) values > 50 µg/ml; Geometric means were calculated for viruses neutralized with an IC$_{50}$ (or IC$_{80}$) value < 50 µg/ml.

FIG. 16

Table S2b: Antibody neutralization data against 22 HIV-1 clade A Env-pseudoviruses

| | | | IC$_{50}$ (µg/ml)* | | | | | | IC$_{90}$ (µg/ml)* | | | | | |
|---|---|---|---|---|---|---|---|---|---|---|---|---|---|---|
| Virus ID | Clade | Origin | Serum45 IgG | VRC01 | VRC02 | VRC03 | b12 | CD4-Ig | Serum45 IgG | VRC01 | VRC02 | VRC03 | b12 | CD4-Ig |
| BS208.B1 | A | Kenya | 5 | | | | | | 46 | | | 2.6 | | 20.8 |
| Q842.d12 | A | Kenya | 50 | | | >50 | >50 | >50 | 177 | | | >50 | >50 | >50 |
| DJ263.8 | A | Kenya | 31 | | | >50 | | | 181 | | | >50 | >50 | |
| Q769.h5 | A | Kenya | 87 | | | | >50 | 1.3 | 879 | | | | >50 | 5.7 |
| Q23.17 | A | Kenya | 33 | | | | >50 | 12.7 | 150 | | | | >50 | >50 |
| KNH1209.18 | A | Kenya | 87 | | | 45.0 | | 6.0 | 274 | | | >50 | 1.6 | >50 |
| MS208.A1 | A | Kenya | 1000 | | | >50 | | 7.6 | >1000 | | | >50 | 1.1 | 40.9 |
| Q168.a2 | A | Kenya | 118 | | | 3.4 | >50 | 11.6 | 559 | | | 27.6 | >50 | >50 |
| Q259.w6 | A | Kenya | 13 | | | | >50 | | 41 | | | | >50 | 2.8 |
| KER2008.12 | A | Kenya | 184 | | | | >50 | | >1000 | 1.7 | | 1.7 | >50 | 4.0 |
| Q461.e2 | A | Kenya | >1000 | | | >50 | >50 | 25.4 | >1000 | 1.6 | 1.4 | >50 | >50 | >50 |
| KER2018.11 | A | Kenya | >1000 | | | | >50 | 3.3 | >1000 | 2.3 | 1.9 | 1.3 | >50 | 16.9 |
| RW020.2 | A | Rwanda | 143 | | | >50 | 10.1 | 11.7 | 887 | | | >50 | 33.5 | 46.1 |
| 3415.v1.c1 | A | Tanzania | 54 | | | | 2.5 | 12.6 | 200 | | | | 14.1 | >50 |
| 3365.v2.c20 | A | Tanzania | 94 | | | | 10.7 | | 266 | | | 9.7 | >50 | |
| 0330.v4.c3 | A | Tanzania | 152 | | | >50 | >50 | | 628 | | | >50 | >50 | 4.7 |
| 783.v0.c51 | A | Tanzania | | | | 1.6 | 23.3 | 6.7 | | | | 11.2 | >50 | 39.8 |
| 398-F1_F6_20 | A | Tanzania | | | | | | 11.7 | | | | 2.0 | 1.8 | >50 |
| 218-F2_E3_5 | A | Tanzania | | | | >50 | >50 | 30.1 | | | | >50 | >50 | >50 |
| 0260.v5.c36 | A | Tanzania | | 1.1 | | >50 | >50 | | | 2.0 | 3.1 | | >50 | >50 |
| 3718.v3.c11 | A | Tanzania | 574 | 1.2 | | >50 | 18.9 | 14.6 | >1000 | >50 | >50 | >50 | >50 | >50 |
| UG037.8 | A | Uganda | 220 | | | 12.1 | >50 | | 731 | | | >50 | >50 | |
| Breadth | N=22 | Titer < 50 | | 100% | 100% | 64% | 45% | 91% | | 95% | 95% | 55% | 27% | 55% |
| | | Titer < 1 | | 95% | 95% | 45% | 23% | 32% | | 77% | 82% | 23% | 5% | 14% |
| Median# | | | | 0.11 | 0.10 | 2.47 | >50 | 8.39 | | 0.50 | 0.39 | 19.50 | >50 | 43.50 |
| Geometric mean# | | | | 0.15 | 0.13 | 0.40 | 1.29 | 2.66 | | 0.45 | 0.40 | 0.97 | 2.67 | 5.46 |

*Values < 1 µg/ml are highlighted in red, and values 1 – 50 µg/ml are in green. Blanks indicate not tested.
Medians were calculated based on all viruses tested, including those with values > 50 µg/ml, which were assigned a value of 100; Geometric means were calculated for neutralization sensitive viruses with an IC$_{50}$ (or IC$_{90}$) value < 50 µg/ml.

FIG. 17

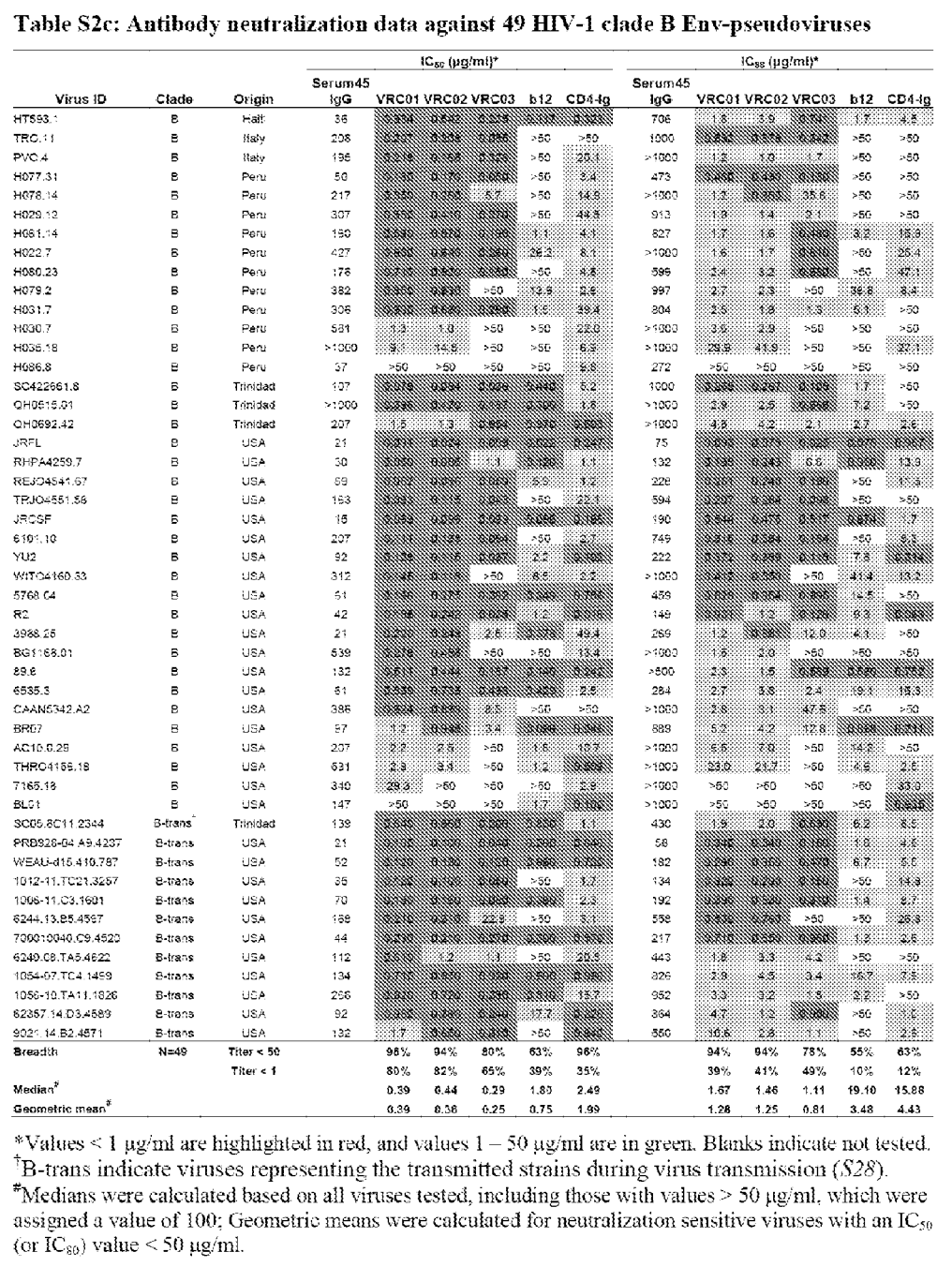

Table S2c: Antibody neutralization data against 49 HIV-1 clade B Env-pseudoviruses

*Values < 1 µg/ml are highlighted in red, and values 1 – 50 µg/ml are in green. Blanks indicate not tested.
†B-trans indicate viruses representing the transmitted strains during virus transmission (S28).
Medians were calculated based on all viruses tested, including those with values > 50 µg/ml, which were assigned a value of 100; Geometric means were calculated for neutralization sensitive viruses with an $IC_{50}$ (or $IC_{80}$) value < 50 µg/ml.

FIG. 18

Table S2d: Antibody neutralization data against 38 HIV-1 clade C Env-pseudoviruses

| | | | $IC_{50}$ (µg/ml)* | | | | | | $IC_{80}$ (µg/ml)* | | | | | |
|---|---|---|---|---|---|---|---|---|---|---|---|---|---|---|
| Virus ID | Clade | Origin | Serum45 IgG | VRC01 | VRC02 | VRC03 | b12 | CD4-Ig | Serum45 IgG | VRC01 | VRC02 | VRC03 | b12 | CD4-Ig |
| BR025.9 | C | Brazil | 25 | | | >50 | >50 | | 242 | | | >50 | >50 | |
| 286.36 | C | Ethiopia | 47 | | | 1.6 | | 7.5 | 141 | | | 16.4 | 2.7 | 39.1 |
| 288.38 | C | Ethiopia | 100 | | | | >50 | | 484 | 4.0 | 2.6 | 1.2 | >50 | 2.1 |
| 001428-2.42 | C | India | 26 | | | | 39.2 | | 58 | | | | >50 | 3.1 |
| 16055-2.3 | C | India | 83 | | | | >50 | | 309 | | | 1.9 | >50 | 11.6 |
| 0013095-2.11 | C | India | 65 | | | | >50 | | 183 | | | 2.9 | >50 | 1.3 |
| 16936-2.21 | C | India | 194 | | | | 41.8 | | 596 | | | | >50 | 5.3 |
| 26191-2.48 | C | India | 340 | | | >50 | 1.5 | | 827 | | | >50 | 7.4 | 10.1 |
| 25710-2.43 | C | India | 162 | | | | >50 | | 633 | 1.4 | 1.4 | | >50 | 2.1 |
| 25925-2.22 | C | India | 312 | | | | >50 | 2.6 | 679 | 1.6 | 1.2 | 1.0 | >50 | 20.2 |
| 25711-2.4 | C | India | 504 | 1.0 | | | 8.7 | 13.3 | >1000 | 2.4 | 1.7 | 3.7 | 48.8 | >50 |
| 16845-2.22 | C | India | 509 | 2.8 | 4.0 | 48.5 | >50 | | >1000 | 12.7 | 18.9 | >50 | >50 | |
| S018.18 | C | Malawi | 31 | | | | 13.9 | 8.9 | 115 | | | | >50 | >50 |
| Du156.12 | C | South Africa | 115 | | | >50 | | 14.5 | 475 | | | >50 | 2.8 | >50 |
| CAP45.2.00.G3 | C | South Africa | 134 | 2.3 | 5.7 | >50 | | 2.1 | >500 | >50 | >50 | >50 | 4.1 | >50 |
| ZA012.29 | C | South Africa | 72 | | | 9.2 | >50 | 5.4 | 381 | 1.0 | | >50 | >50 | 45.7 |
| CAP244.2.00.D3 | C | South Africa | 238 | | | 47.1 | >50 | 2.6 | 1000 | 2.7 | 2.1 | >50 | >50 | 17.5 |
| Du151.2 | C | South Africa | 248 | 3.2 | 4.8 | 34.6 | 3.3 | 1.4 | >1000 | 46.5 | >50 | >50 | >50 | 8.0 |
| Du123.6 | C | South Africa | 393 | 18.2 | 16.1 | >50 | 1.3 | | >500 | >50 | >50 | >50 | 9.3 | |
| Du172.17 | C | South Africa | 349 | >50 | >50 | >50 | | 0.260 | >1000 | >50 | >50 | >50 | 2.6 | 1.5 |
| Du422.1 | C | South Africa | >1000 | >50 | >50 | >50 | | 11.5 | >1000 | >50 | >50 | >50 | .6 | >50 |
| CAP210.2.00.E8 | C | South Africa | 423 | >50 | >50 | >50 | 37.0 | 1.480 | >1000 | >50 | >50 | >50 | | 8.3 |
| TV1.29 | C | South Africa | >1000 | >50 | >50 | >50 | >50 | | >1000 | >50 | >50 | >50 | >50 | 1.0 |
| TZBD.02 | C | Tanzania | 56 | | | 1.3 | >50 | | 220 | | | 22.1 | >50 | 5.7 |
| TZA125.17 | C | Tanzania | 97 | >50 | >50 | >50 | >50 | | >1000 | >50 | >50 | >50 | >50 | 39.5 |
| ZM249M.PL1 | C | Zambia | 27 | | | 6.6 | 3.810 | 1.1 | 262 | | | >50 | 20.3 | >50 |
| ZM176.66 | C | Zambia | 15 | | | | >50 | | 151 | | | | >50 | 35.4 |
| ZM215.8 | C | Zambia | 89 | | | >50 | >50 | 1.2 | >1000 | | | >50 | >50 | >50 |
| ZM109F.PB4 | C | Zambia | 73 | | | >50 | >50 | | 915 | | | >50 | >50 | |
| ZM146.7 | C | Zambia | 67 | | | 1.0 | 18.0 | 4.2 | 706 | 1.3 | 1.4 | 4.5 | >50 | >50 |
| ZM55.28a | C | Zambia | 156 | | | >50 | >50 | >50 | 436 | 1.3 | 1.0 | >50 | >50 | >50 |
| ZM135M.PL10a | C | Zambia | 268 | | | >50 | >50 | | >1000 | 2.7 | 1.8 | >50 | >50 | 9.3 |
| ZM197M.PB7 | C | Zambia | 605 | | | 2.13 | 11.9 | 28.3 | >1000 | 1.6 | 2.0 | 9.2 | >50 | >50 |
| ZM214M.PL15 | C | Zambia | 141 | | | 18.8 | 13.6 | 26.6 | >1000 | 2.6 | 3.2 | >50 | 40.4 | >50 |
| ZM106.9 | C | Zambia | 212 | | | | >50 | >50 | 623 | 1.3 | | | >50 | >50 |
| ZM181.6 | C | Zambia | 247 | 1.1 | | >50 | >50 | 4.0 | >1000 | 6.5 | 3.3 | >50 | >50 | 31.9 |
| ZM53M.PB12 | C | Zambia | 317 | 1.3 | 1.4 | 10.3 | 32.6 | 8.5 | >1000 | 4.0 | 4.9 | 46.6 | >50 | 32.2 |
| ZM233M.PB6 | C | Zambia | 698 | 2.0 | | >50 | >50 | 3.4 | >1000 | 1.9 | 4.7 | >50 | >50 | 12.4 |
| Breadth | N=38 | Titer < 50 | | 87% | 87% | 58% | 47% | 95% | | 82% | 79% | 42% | 26% | 68% |
| | | Titer < 1 | | 66% | 71% | 29% | 13% | 39% | | 37% | 39% | 16% | 0% | 8% |
| Median[f] | | | | 0.39 | 0.40 | 26.7 | >50 | 1.42 | | 1.50 | 1.39 | >50 | >50 | 18.85 |
| Geometric mean[#] | | | | 0.34 | 0.35 | 1.07 | 4.46 | 1.40 | | 1.14 | 0.93 | 1.60 | 7.25 | 6.17 |

*Values < 1 µg/ml are highlighted in red, and values 1 – 50 µg/ml are in green. Blanks indicate not tested.
[#]Medians were calculated based on all viruses tested, including those with values > 50 µg/ml, which were assigned a value of 100; Geometric means were calculated for neutralization sensitive viruses with an $IC_{50}$ (or $IC_{80}$) value < 50 µg/ml.

FIG. 19

Table S2e: Antibody neutralization data against 8 HIV-1 clade D Env-pseudoviruses

| | | | IC₅₀ (µg/ml)* | | | | | | IC₈₀ (µg/ml)* | | | | | |
|---|---|---|---|---|---|---|---|---|---|---|---|---|---|---|
| Virus ID | Clade | Origin | Serum45 IgG | VRC01 | VRC02 | VRC03 | b12 | CD4-Ig | Serum45 IgG | VRC01 | VRC02 | VRC03 | b12 | CD4-Ig |
| 247-23 | D | Cameroon | | | | >50 | >50 | | | >50 | | >50 | >50 | |
| NKU3006.ec1 | D | Kenya | | | | | | | | | | | >50 | |
| 3016.v5.c45 | D | Tanzania | | | | >50 | | | | | | >50 | | |
| 6405.v4.c34 | D | Tanzania | | | | >50 | >50 | | | | | >50 | >50 | >50 |
| UG024.2 | D | Uganda | 14 | | | >50 | >50 | | 49 | | | >50 | >50 | |
| 231965.c1 | D | Uganda | | | | | | | | | | >50 | | |
| A03349M1.vrc4a | D | Uganda | | | | >50 | | | | | | >50 | | |
| 57128.02 | D | Uganda | 38 | >50 | >50 | >50 | | | 308 | >50 | >50 | >50 | | |
| Breadth | N=8 | Titer < 50 | | 88% | 88% | 25% | 63% | 100% | | 75% | 88% | 13% | 50% | 88% |
| | | Titer < 1 | | 50% | 63% | 13% | 25% | 38% | | 25% | 25% | 13% | 13% | 25% |
| Median# | | | | 1.37 | 0.72 | >50 | 10.25 | 1.82 | | 3.91 | 5.11 | >50 | >50 | 6.93 |
| Geometric mean# | | | | 0.73 | 0.68 | 1.40 | 0.91 | 1.10 | | 1.83 | 2.78 | 0.19 | 1.93 | 2.76 |

*Values < 1 µg/ml are highlighted in red, and values 1 – 50 µg/ml are in green. Blanks indicate not tested.
Medians were calculated based on all viruses tested, including those with values > 50 µg/ml, which were assigned a value of 100; Geometric means were calculated for neutralization sensitive viruses with an IC₅₀ (or IC₈₀) value < 50 µg/ml.

FIG. 20

Table S2f: Antibody neutralization data against 18 HIV-1 CRF01_AE Env-pseudoviruses

| | | | IC₅₀ (µg/ml)* | | | | | | IC₈₀ (µg/ml)* | | | | | |
|---|---|---|---|---|---|---|---|---|---|---|---|---|---|---|
| Virus ID | Clade | Origin | Serum45 IgG | VRC01 | VRC02 | VRC03 | b12 | CD4-Ig | Serum45 IgG | VRC01 | VRC02 | VRC03 | b12 | CD4-Ig |
| CNE5 | CRF01_AE | China | | | | 5.03 | 41.2 | | | | 2.0 | 29.8 | >50 | |
| CNE55 | CRF01_AE | China | | | | | >50 | | | | | 8.5 | >50 | >50 |
| CNE56 | CRF01_AE | China | | | | >50 | >50 | | | | | >50 | >50 | >50 |
| CNE58 | CRF01_AE | China | | | | >50 | >50 | | | | | >50 | >50 | |
| CNE6 | CRF01_AE | China | | 1.3 | 1.7 | 37.1 | >50 | >50 | | 3.7 | 4.7 | >50 | >50 | >50 |
| CNE3 | CRF01_AE | China | | 17.7 | 2.2 | >50 | >50 | | | >50 | 15.9 | >50 | >50 | >50 |
| CNE28 | CRF01_AE | China | | >50 | >50 | >50 | >50 | 8.9 | | >50 | >50 | >50 | >50 | 29.8 |
| R2184.c4 | CRF01_AE | Thailand | 192 | | | | >50 | 7.4 | 476 | | | | >50 | 25.3 |
| TH976.17 | CRF01_AE | Thailand | 25 | | | >50 | >50 | | 1000 | | | >50 | >50 | 40.8 |
| C3347.c11 | CRF01_AE | Thailand | | | | 2.4 | >50 | | | | | 39.1 | >50 | >50 |
| TH966.8 | CRF01_AE | Thailand | 102 | | | >50 | >50 | | >1000 | 1.4 | 1.2 | >50 | >50 | 3.2 |
| M02138 | CRF01_AE | Thailand | 93 | | | >50 | >50 | | 392 | 1.6 | 2.0 | >50 | >50 | 2.8 |
| C2101.c1 | CRF01_AE | Thailand | | | | >50 | >50 | 9.3 | | | | >50 | >50 | 29.2 |
| R3265.c6 | CRF01_AE | Thailand | | | | >50 | >50 | 8.1 | | 1.9 | 2.2 | >50 | >50 | 29.0 |
| R1166.c1 | CRF01_AE | Thailand | | 1.7 | 1.8 | >50 | >50 | 36.4 | | 4.6 | 4.9 | >50 | >50 | >50 |
| C1080.c3 | CRF01_AE | Thailand | 855 | 3.4 | 3.8 | >50 | >50 | 4.3 | >1000 | 14.4 | 15.3 | >50 | >50 | 16.3 |
| 703357.2 | CRF01_AE | Thailand | >1000 | 4.3 | 3.7 | >50 | >50 | | >1000 | 11.1 | 10.6 | >50 | >50 | >50 |
| 620345.c1 | CRF01_AE | Thailand | >1000 | >50 | >50 | >50 | >50 | >50 | >1000 | >50 | >50 | >50 | >50 | >50 |
| Breadth | N=18 | Titer < 50 | | 89% | 89% | 28% | 6% | 78% | | 83% | 89% | 22% | 0% | 56% |
| | | Titer < 1 | | 61% | 61% | 11% | 0% | 22% | | 17% | 22% | 6% | 0% | 0% |
| Median# | | | | 0.44 | 0.50 | >50 | >50 | 10.80 | | 1.72 | 2.08 | >50 | >50 | 35.29 |
| Geometric mean# | | | | 0.61 | 0.56 | 2.01 | 41.20 | 4.89 | | 1.77 | 2.15 | 5.67 | >50 | 14.45 |

*Values < 1 µg/ml are highlighted in red, and values 1 – 50 µg/ml are in green. Blanks indicate not tested.
Medians were calculated based on all viruses tested, including those with values > 50 µg/ml, which were assigned a value of 100; Geometric means were calculated for neutralization sensitive viruses with an IC₅₀ (or IC₈₀) value < 50 µg/ml.

FIG. 21

Table S2g: Antibody neutralization against 16 CRF02_AG Env-pseudoviruses

| | | | $IC_{50}$ (µg/ml)* | | | | | | $IC_{80}$ (µg/ml)* | | | | | |
|---|---|---|---|---|---|---|---|---|---|---|---|---|---|---|
| Virus ID | Clade | Origin | Serum45 IgG | VRC01 | VRC02 | VRC03 | b12 | CD4-Ig | Serum45 IgG | VRC01 | VRC02 | VRC03 | b12 | CD4-Ig |
| 260-5 | CRF02_AG | Cameroon | 41 | | | | >50 | 4.2 | 129 | | | | >50 | 37.6 |
| 33-7 | CRF02_AG | Cameroon | 109 | | | >50 | >50 | | 302 | | | >50 | >50 | 8.1 |
| 235-47 | CRF02_AG | Cameroon | 45 | | | | 6.5 | 29.0 | 232 | | | 1.5 | >50 | >50 |
| 271-11 | CRF02_AG | Cameroon | 55 | | | >50 | >50 | | 192 | | | >50 | >50 | |
| 263-8 | CRF02_AG | Cameroon | 98 | | | >50 | >50 | 1.0 | 465 | | | >50 | >50 | 8.3 |
| 269-12 | CRF02_AG | Cameroon | | | | >50 | >50 | 4.5 | | | | >50 | >50 | 22.8 |
| 253-11 | CRF02_AG | Cameroon | 541 | | | >50 | >50 | 13.1 | >1000 | 1.4 | 1.4 | >50 | >50 | >50 |
| 255-34 | CRF02_AG | Cameroon | 476 | | | >50 | >50 | | >1000 | 2.7 | 1.9 | >50 | >50 | 1.1 |
| 266-60 | CRF02_AG | Cameroon | 592 | 1.3 | 1.4 | >50 | 4.2 | 2.5 | >1000 | 4.3 | 5.0 | >50 | 42.7 | >50 |
| 251-18 | CRF02_AG | Cameroon | 841 | 2.5 | 3.1 | >50 | >50 | 3.1 | >1000 | 11.2 | 10.4 | >50 | >50 | 27.3 |
| 257-31 | CRF02_AG | Cameroon | 683 | 2.3 | 2.8 | >50 | >50 | 20.1 | >1000 | 8.7 | 8.7 | >50 | >50 | >50 |
| 211-9 | CRF02_AG | Cameroon | 438 | 14.3 | 5.5 | >50 | >50 | 5.6 | >1000 | >50 | >50 | >50 | >50 | 31.9 |
| 250-4 | CRF02_AG | Cameroon | 90 | >50 | >50 | >50 | >50 | 6.0 | 382 | >50 | >50 | >50 | >50 | 43.1 |
| 278-50 | CRF02_AG | Cameroon | >1000 | >50 | >50 | >50 | 18.4 | 1.6 | >1000 | >50 | >50 | >50 | >50 | 8.0 |
| 242-14 | CRF02_AG | Cameroon | 322 | >50 | >50 | >50 | >50 | 1.9 | >1000 | >50 | >50 | >50 | >50 | 15.5 |
| 928-28 | CRF02_AG | Cote d'Ivoire | 517 | | | >50 | >50 | | >1000 | 1.7 | 2.0 | >50 | >50 | 3.3 |
| Breadth | N=16 | Titer < 50 | | 81% | 81% | 19% | 19% | 100% | | 75% | 81% | 19% | 6% | 75% |
| | | Titer < 1 | | 56% | 56% | 19% | 0% | 25% | | 38% | 38% | 13% | 0% | 6% |
| Median[#] | | | | 0.59 | 0.59 | >50 | >50 | 2.82 | | 2.20 | 1.92 | >50 | >50 | 25.09 |
| Geometric mean[#] | | | | 0.35 | 0.35 | 0.06 | 8.04 | 2.28 | | 0.95 | 1.18 | 0.47 | 42.7 | 7.96 |

*Values < 1 µg/ml are highlighted in red, and values 1 – 50 µg/ml are in green. Blanks indicate not tested.
[#]Medians were calculated based on all viruses tested, including those with values > 50 µg/ml, which were assigned a value of 100; Geometric means were calculated for neutralization sensitive viruses with an $IC_{50}$ (or $IC_{80}$) value < 50 µg/ml.

FIG. 22

Table S2h: Antibody neutralization data against 10 HIV-1 clade G Env-pseudoviruses

| | | | $IC_{50}$ (µg/ml)* | | | | | | $IC_{80}$ (µg/ml)* | | | | | |
|---|---|---|---|---|---|---|---|---|---|---|---|---|---|---|
| Virus ID | Clade | Origin | Serum45 IgG | VRC01 | VRC02 | VRC03 | b12 | CD4-Ig | Serum45 IgG | VRC01 | VRC02 | VRC03 | b12 | CD4-Ig |
| X2088_c9 | G | Ghana | | >50 | >50 | >50 | >50 | 2.4 | | >50 | >50 | >50 | >50 | 8.3 |
| P0402_c2_11 | G | Portugal | | | | >50 | >50 | 11.4 | | | | >50 | >50 | >50 |
| X1254_c3 | G | Spain | | | | >50 | >50 | 9.2 | | | | | >50 | 29.7 |
| X1193_c1 | G | Spain | | | | | >50 | 21.3 | | | | | >50 | >50 |
| X1632_S2_B10 | G | Spain | | | | | >50 | | | | | | >50 | 1.6 |
| X1854_c2_10 | G | Spain | | | | 26.7 | >50 | 5.7 | | | | >50 | >50 | 19.5 |
| P1981_C5_3 | G | Spain | | | | | >50 | 41.3 | | 1.3 | 1.5 | 1.9 | >50 | >50 |
| X2131_C1_B5 | G | Spain | | | 1.7 | >50 | | | 1.5 | 1.7 | 8.8 | >50 | 1.3 |
| X2180_c25 | G | Spain | | | | 23.1 | >50 | 3.8 | | 4.6 | 3.1 | >50 | >50 | 12.1 |
| 252-7 | G | West Africa | | | | >50 | >50 | 20.1 | | 2.4 | 2.2 | >50 | >50 | >50 |
| Breadth | N=10 | Titer < 50 | | 90% | 90% | 60% | 0% | 100% | | 90% | 90% | 40% | 0% | 60% |
| | | Titer < 1 | | 90% | 90% | 30% | 0% | 20% | | 50% | 50% | 20% | 0% | 0% |
| Median[#] | | | | 0.34 | 0.42 | 24.91 | >50 | 7.44 | | 1.00 | 1.12 | >50 | >50 | 24.61 |
| Geometric mean[#] | | | | 0.25 | 0.29 | 1.14 | >50 | 5.14 | | 0.86 | 0.89 | 0.91 | >50 | 7.10 |

*Values < 1 µg/ml are highlighted in red, and values 1 – 50 µg/ml are in green. Blanks indicate not tested.
[#]Medians were calculated based on all viruses tested, including those with values > 50 µg/ml, which were assigned a value of 100; Geometric means were calculated for neutralization sensitive viruses with an $IC_{50}$ (or $IC_{80}$) value < 50 µg/ml.

FIG. 23

Table S2i: Antibody neutralization data against 11 HIV-1 CRF07_BC Env-pseudoviruses

| | | | $IC_{50}$ (µg/ml)* | | | | | | $IC_{80}$ (µg/ml)* | | | | | |
|---|---|---|---|---|---|---|---|---|---|---|---|---|---|---|
| Virus ID | Clade | Origin | Serum45 IgG | VRC01 | VRC02 | VRC03 | b12 | CD4-Ig | Serum45 IgG | VRC01 | VRC02 | VRC03 | b12 | CD4-Ig |
| CH117.4 | CRF07_BC | China | 42 | | | | >50 | 3.9 | 135 | | | | >50 | 6.9 |
| CH114.8 | CRF07_BC | China | | | | | >50 | | | | | | >50 | 3.9 |
| CH064.2 | CRF07_BC | China | 289 | | | | | 1.4 | 629 | 1.4 | | 1.9 | >50 | 6.7 |
| CH181.12 | CRF07_BC | China | 257 | | | 7.6 | | | 745 | 1.7 | | >50 | 3.3 | 3.5 |
| CH038.12 | CRF07_BC | China | 436 | | | >50 | | 3.3 | >1000 | 1.6 | 1.4 | >50 | | 7.1 |
| CH119.1 | CRF07_BC | China | 182 | 1.3 | 1.3 | 18.9 | >50 | 4.0 | 694 | 3.5 | 3.5 | >50 | >50 | 15.0 |
| CH110.2 | CRF07_BC | China | 82 | 1.9 | | 1.5 | >50 | 1.1 | 235 | 10.7 | 4.9 | >50 | >50 | 5.7 |
| CH115.12 | CRF07_BC | China | 746 | 2.7 | 3.2 | | >50 | 35.5 | >1000 | 9.5 | 9.5 | 1.0 | >50 | >50 |
| CH120.6 | CRF07_BC | China | 666 | 3.1 | 3.2 | | >50 | 1.2 | >1000 | 11.4 | 11.4 | 2.6 | >50 | 4.4 |
| CH111.8 | CRF07_BC | China | 595 | 3.9 | 2.9 | >50 | >50 | | >1000 | 11.5 | 10.9 | >50 | >50 | 7.5 |
| CH070.1 | CRF07_BC | China | >1000 | 37.7 | 17.2 | >50 | >50 | | >1000 | >50 | >50 | >50 | >50 | 2.9 |
| Breadth | N=11 | Titer < 50 | | 100% | 100% | 73% | 27% | 100% | | 91% | 91% | 45% | 18% | 91% |
| | | Titer < 1 | | 45% | 55% | 45% | 9% | 36% | | 18% | 27% | 18% | 9% | 0% |
| Median# | | | | 1.25 | 0.95 | 1.47 | >50 | 1.20 | | 3.53 | 3.54 | >50 | >50 | 7.52 |
| Geometric mean# | | | | 1.23 | 0.96 | 0.74 | 2.57 | 1.95 | | 3.05 | 2.39 | 0.83 | 2.32 | 7.03 |

*Values < 1 µg/ml are highlighted in red, and values 1 – 50 µg/ml are in green. Blanks indicate not tested.
Medians were calculated based on all viruses tested, including those with values > 50 µg/ml, which were assigned a value of 100; Geometric means were calculated for neutralization sensitive viruses with an $IC_{50}$ (or $IC_{80}$) value < 50 µg/ml.

FIG. 24

Table S2j: Antibody neutralization against 18 HIV-1 recombinant Env-pseudoviruses

| | | | $IC_{50}$ (µg/ml)* | | | | | | $IC_{80}$ (µg/ml)* | | | | | |
|---|---|---|---|---|---|---|---|---|---|---|---|---|---|---|
| Virus ID | Clade | Origin | Serum45 IgG | VRC01 | VRC02 | VRC03 | b12 | CD4-Ig | Serum45 IgG | VRC01 | VRC02 | VRC03 | b12 | CD4-Ig |
| 6041.v3.c23 | AC | Tanzania | | | | 14.4 | >50 | 10.0 | | | | >50 | >50 | 31.7 |
| 3589.v1.c4 | AC | Tanzania | | 0.12 | 0.12 | >50 | >50 | 13.0 | | 0.47 | 0.35 | >50 | >50 | 47.1 |
| 3301.v1.c24 | AC | Tanzania | | | | | 28.6 | 2.9 | | | | 0.31 | >50 | 10.1 |
| 6545.v4.c1 | AC | Tanzania | | >50 | >50 | >50 | 31.5 | 3.0 | | >50 | >50 | >50 | | 11.4 |
| 6540.v4.c1 | AC | Tanzania | | >50 | >50 | >50 | 18.1 | 3.7 | | >50 | >50 | >50 | | 11.7 |
| 0815.v3.c3 | ACD | Tanzania | | | | | 11.2 | 3.0 | | | | | >50 | 9.4 |
| 3103.v3.c10 | ACD | Tanzania | | | | | >50 | 30.5 | | 2.5 | 2.0 | 2.3 | >50 | >50 |
| 3468.v1.c12 | AD | Tanzania | | | | >50 | >50 | 7.3 | | | | >50 | >50 | >50 |
| 0907.v4.c12 | AD | Tanzania | | | | | >50 | 19.1 | | | | | >50 | >50 |
| 6480.v4.c25 | CD | Tanzania | | | | | >50 | 6.4 | | | | | >50 | 17.6 |
| 6952.v1.c20 | CD | Tanzania | | | | 6.4 | 2.9 | | | | | | 24.5 | 7.7 |
| 6650.v1.c8 | CD | Tanzania | | | | | >50 | 29.1 | | | | | >50 | >50 |
| 6811.v5.c20 | CD | Tanzania | | | 2.2 | >50 | 7.9 | | 0.36 | | 29.3 | >50 | 19.6 |
| 3326.v4.c3 | CD | Tanzania | | | | >50 | | 50.0 | | 2.3 | 1.4 | >50 | | >50 |
| 3337.v2.c6 | CD | Tanzania | | | | >50 | >50 | | | | | >50 | >50 | 1.3 |
| 3817.v2.c59 | CD | Tanzania | | >50 | >50 | >50 | >50 | >50 | | >50 | >50 | >50 | >50 | >50 |
| X2253_c7 | CRF14_BG | Portugal | | | | | >50 | 2.9 | | 1.1 | 1.6 | 1.3 | >50 | 13.1 |
| X1100_c7 | CRF14_BG | Switzerland | | 1.3 | | >50 | >50 | 10.0 | | >50 | 6.6 | >50 | >50 | 33.3 |
| Breadth | N=18 | Titer < 50 | | 83% | 83% | 56% | 33% | 94% | | 78% | 83% | 50% | 11% | 67% |
| | | Titer < 1 | | 78% | 83% | 44% | 6% | 6% | | 61% | 61% | 33% | 6% | 0% |
| Median# | | | | 0.13 | 0.12 | 8.33 | >50 | 7.87 | | 0.41 | 0.46 | >50 | >50 | 25.67 |
| Geometric mean# | | | | 0.12 | 0.13 | 0.20 | 6.99 | 6.56 | | 0.33 | 0.44 | 0.43 | 3.25 | 13.12 |

*Values < 1 µg/ml are highlighted in red, and values 1 – 50 µg/ml are in green. Blanks indicate not tested.
Medians were calculated based on all viruses tested, including those with values > 50 µg/ml, which were assigned a value of 100; Geometric means were calculated for neutralization sensitive viruses with an $IC_{50}$ (or $IC_{80}$) value < 50 µg/ml.

FIG. 25

Table S3: $IC_{50}$ titers (μg/ml) of antibody neutralization against selected HIV-1 clade B and C viruses using Env-pseudoviruses to infect TZM-bl or activated PBMC, and using PBMC-derived uncloned primary isolates to infect TZM-bl or activated PBMC

| Virus* | Virus type | Target cell | Serum45 IgG | VRC01 | VRC02 | VRC03 | b12 | CD4-Ig |
|---|---|---|---|---|---|---|---|---|
| Clade B n=9 | | | | | | | | |
| BaL | Primary | TZM-bl | 31 | 0.215 | 0.182 | 3.7 | 0.136 | 0.032 |
| BaL | Primary | PBMC | | 0.142 | | 4.1 | 4.8 | 0.208 |
| BaL.01.SG3 | Pseudo | TZM-bl | 31 | 0.055 | 0.053 | 20 | 0.093 | 0.030 |
| BaL.01.LUC | Pseudo | PBMC | 130 | 0.054 | 0.051 | 11 | 0.343 | 0.134 |
| MN | Primary | TZM-bl | 48 | 0.283 | 0.271 | 0.054 | 0.081 | 0.062 |
| MN | Primary | PBMC | | 0.105 | | 0.020 | 0.060 | 0.024 |
| MN.3.SG3 | Pseudo | TZM-bl | 1.7 | 0.022 | 0.024 | 0.027 | 0.003 | 0.006 |
| JRFL | Primary | TZM-bl | 76 | 0.142 | 0.104 | 0.029 | 0.131 | 1.2 |
| JRFL | Primary | PBMC | | 0.020 | | 0.014 | 0.221 | 1.9 |
| JRFL.SG3 | Pseudo | TZM-bl | 21 | 0.031 | 0.024 | 0.009 | 0.022 | 0.247 |
| JRFL.LUC | Pseudo | PBMC | 67 | 0.035 | 0.010 | 0.004 | 0.014 | 0.560 |
| SF162 | Primary | TZM-bl | 5.0 | 0.289 | 0.289 | 0.079 | 0.021 | 0.036 |
| SF162 | Primary | PBMC | | 0.250 | | 0.040 | 0.062 | 0.062 |
| SF162.SG3 | Pseudo | TZM-bl | 11 | 0.139 | 0.112 | 0.033 | 0.070 | 0.153 |
| 89.6 | Primary | TZM-bl | 14 | 0.813 | 0.640 | 0.110 | 1.2 | 0.289 |
| 89.6 | Primary | PBMC | | 0.046 | | 0.014 | <0.003 | 0.003 |
| 89.6.SG3 | Pseudo | TZM-bl | 132 | 0.511 | 0.444 | 0.187 | 0.140 | 0.242 |
| BL01 | Primary | TZM-bl | >1000 | >50 | >50 | >50 | >50 | 2.0 |
| BL01 | Primary | PBMC | | >50 | | >50 | 5.3 | 0.184 |
| BL01.SG3 | Pseudo | TZM-bl | 147 | >50 | >50 | >50 | 1.7 | 0.100 |
| BR07 | Primary | TZM-bl | >1000 | 6.8 | 7.1 | 2.9 | 3.7 | 0.212 |
| BR07 | Primary | PBMC | | 0.446 | | 0.866 | 0.012 | 0.007 |
| BR07.SG3 | Pseudo | TZM-bl | 97 | 1.2 | 0.948 | 3.4 | 0.098 | 0.046 |
| QH0692.42.SG3 | Pseudo | TZM-bl | 207 | 1.5 | 1.3 | 0.954 | 0.970 | 0.603 |
| QH0692.42.LUC | Pseudo | PBMC | >1000 | 1.9 | 2.5 | 0.236 | 2.4 | 0.643 |
| AC10.29.SG3 | Pseudo | TZM-bl | 207 | 2.2 | 2.5 | >50 | 1.8 | 10.7 |
| AC10.29.LUC | Pseudo | PBMC | >1000 | 2.3 | 2.9 | >50 | 18 | >50 |
| Clade C n=3 | | | | | | | | |
| BR025 | Primary | TZM-bl | 111 | 1.6 | 1.1 | 0.169 | 0.384 | 0.653 |
| BR025 | Primary | PBMC | | 0.568 | | 0.040 | 0.196 | 0.192 |
| BR025.9.SG3 | Pseudo | TZM-bl | 25 | 0.115 | 0.208 | >50 | >50 | 0.064 |
| ZA012 | Primary | TZM-bl | 736 | 1.3 | 0.951 | 21 | >50 | >50 |
| ZA012 | Primary | PBMC | | 2.1 | | 29.2 | >50 | 9.4 |
| ZA012.29.SG3 | Pseudo | TZM-bl | 72 | 0.305 | 0.176 | 9.2 | >50 | 5.4 |
| Du156 | Primary | TZM-bl | 246 | 1.1 | 1.2 | >50 | >50 | 11.0 |
| Du156 | Primary | PBMC | | 0.356 | | >50 | 0.917 | 0.271 |
| Du156.12.SG3 | Pseudo | TZM-bl | 115 | 0.089 | 0.091 | >50 | 0.656 | 14.5 |

*Viruses with suffix of SG3 are Env-pseudoviruses made with the SG3 ΔEnv HIV-1 backbone. These pseudoviruses were used to infect the TZM-bl cell line containing a Tat sensitive luciferase reporter gene. Viruses with suffix of LUC are Env-pseudoviruses made in the pNL4-3 ΔEnv HIV-1 backbone that contained a luciferase reporter gene. This allowed assays with these Env-pseudoviruses on PBMC target cells. Viral isolates with no suffix are primary replication competent PBMC derived viruses. Blanks indicate not tested.

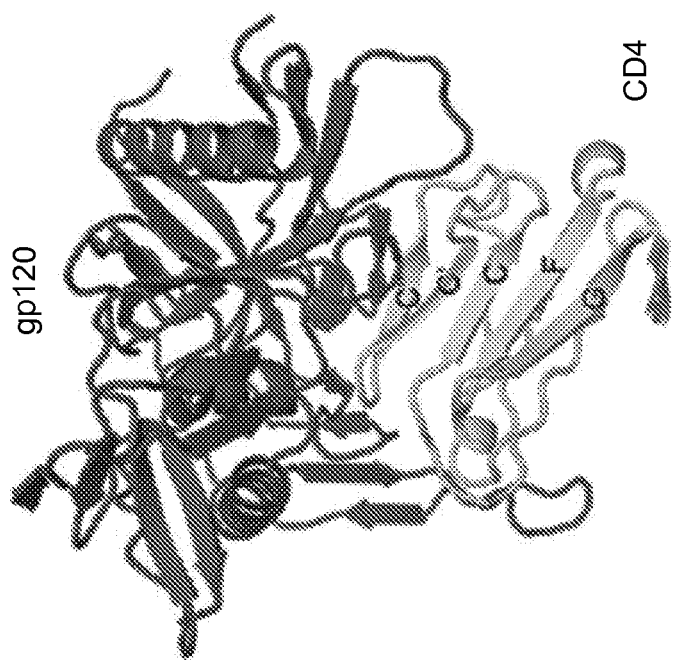
FIG. 27A

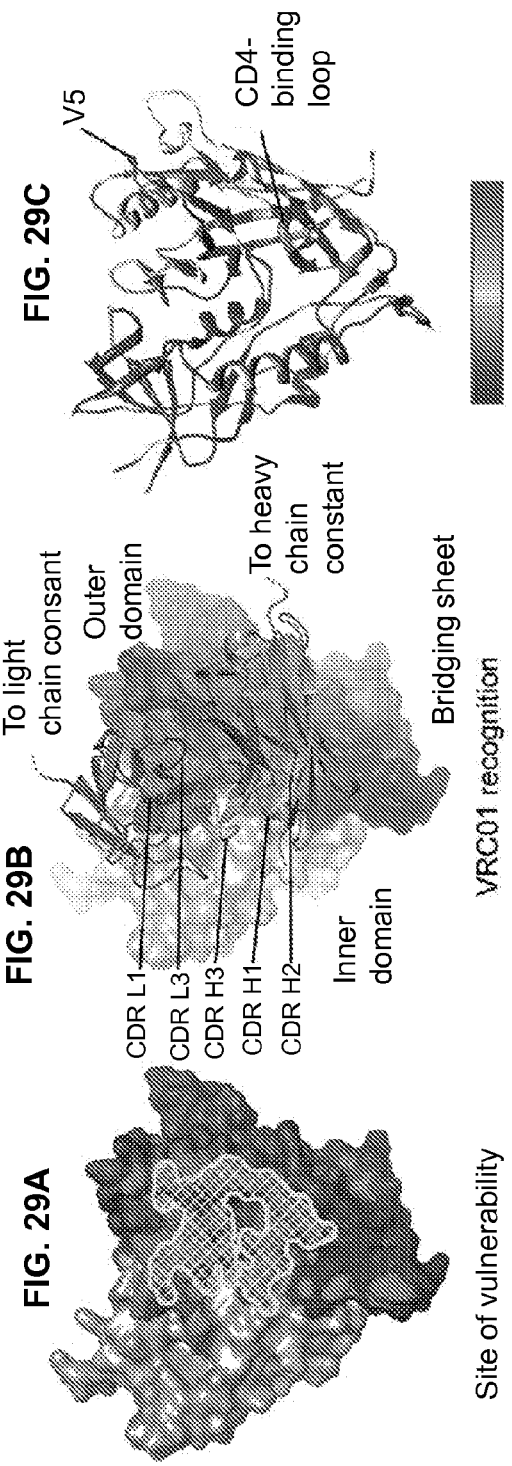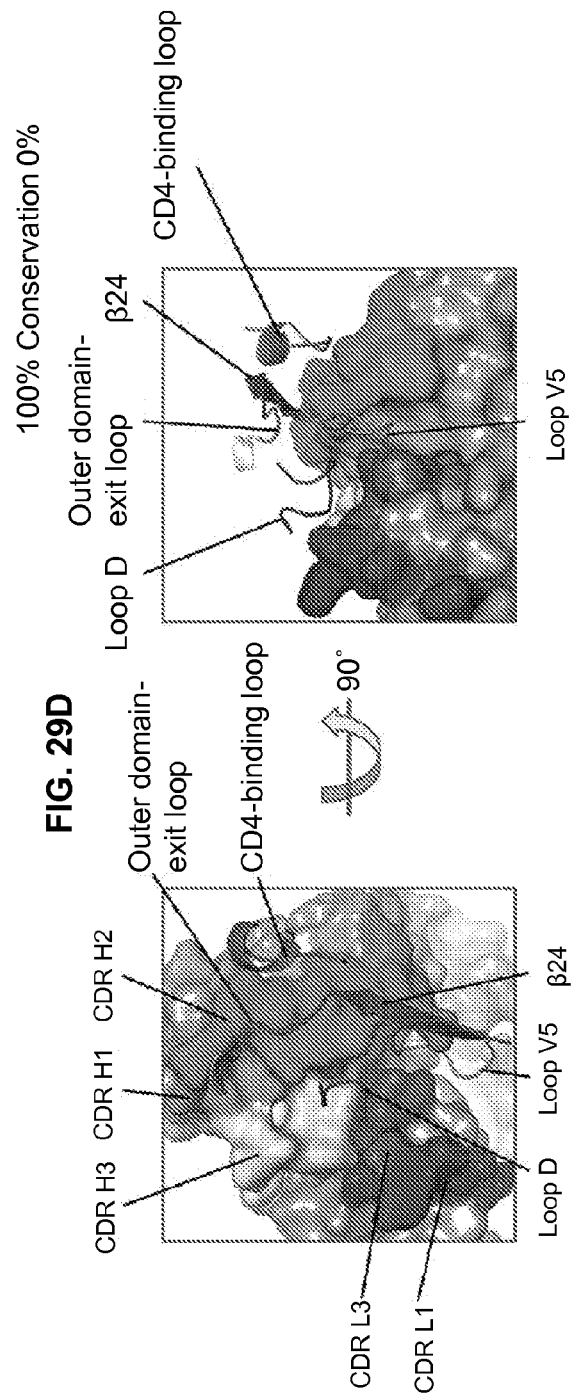

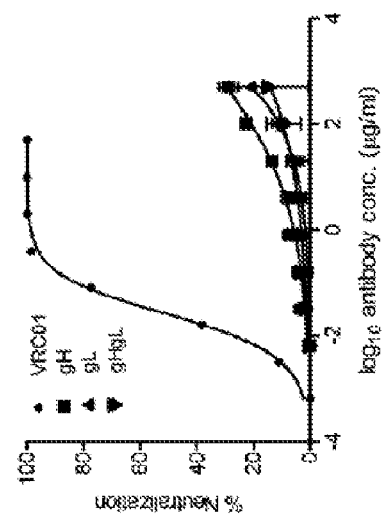
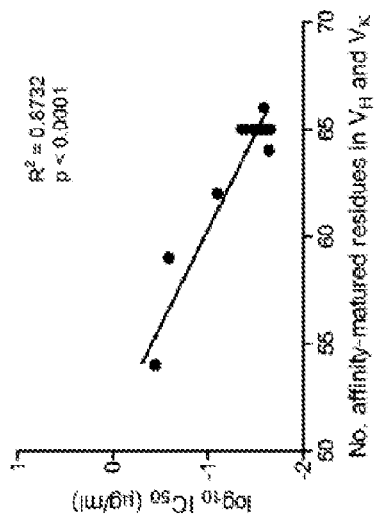
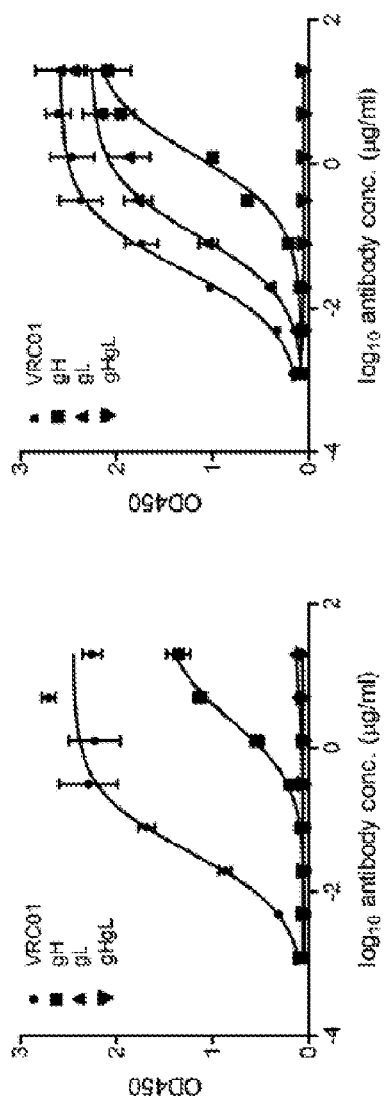
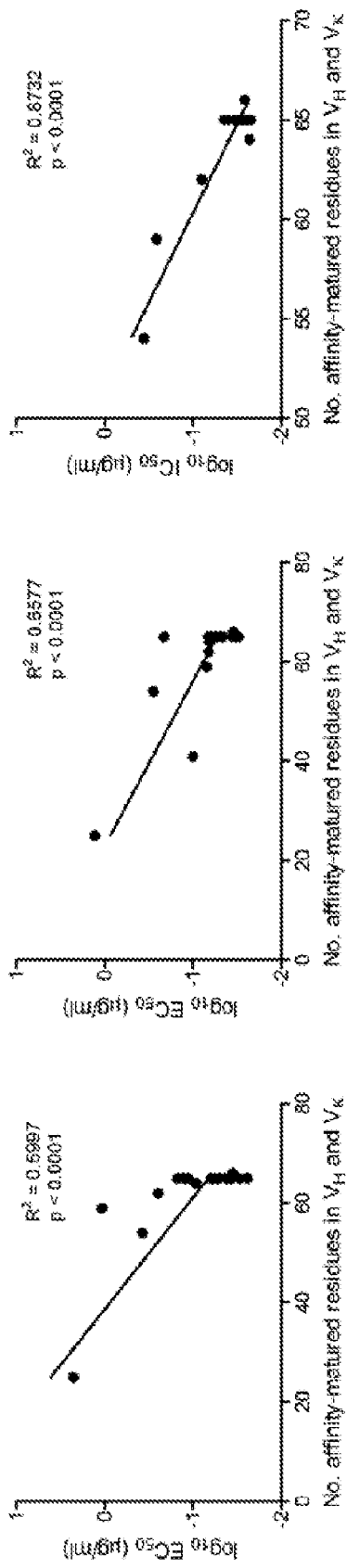
FIG. 31A
FIG. 31B

FIG. 32

```
               50         60         70         80         90
                |          |          |          |          |
93Th057   VWKDADTTLFCASDAKAHETEVHNVWATHACVPTDPNPQEIHLENVTENF
HXBc2     VWKEATTTLFCASDAKAYDTEVHNVWATHACVPTDPNPQEVVLVNVTENF 100        110        120   ****  194   =200
                |          |          |                 |
93Th057   NMWKNNMVEQMQEDVISLWDQSLQPCVKLT----GG-----SVIKQACPK
HXBc2     NMWKNDMVEQMHEDIISLWDQSLKPCVKLTPLCVGAGSCNTSVITQACPK
                                                 V1/V2

210        220        230        240        250
                |          |          |          |          |
93Th057   ISFDPIPIHYCTPAGYVILKCNDKNFNGTGPCKNVSSVQCTHGIKPVVST
HXBc2     VSFEPIPIHYCAPAGFAILKCNNKTFNGTGPCTNVSTVQCTHGIRPVVST 260        270      *****        290        300
                |          |                     |          |
93Th057   QLLLNGSLAEEEIIRSENLTNNAKTIIVHLNKSVEINCTRPSNGGSGSG
HXBc2     QLLLNGSLAEEEVVIRSVNFTDNAKTIIVQLNTSVEINCT-----GAG--
                                Loop D 330        340        350        360     *****
                |          |          |          |
93Th057   GDIRKAYCEINGTKWNKVLKQVTEKLKEHF-NKTIIFQPPSGGDLEITM
HXBc2     ------HCNISRAKWNNTLKQIASKLREQFGNNKTIIFKQSSGGDPEIVT
                                                 CD4-Binding loop 380        390        400        410        420
              |          |          |          |          |
93Th057   HHFNCRGEFFYCNTTQLFNNTCIG-NETMKGCN-----GTTTLPCKIKQI
HXBc2     HSFNCGGEFFYCNSTQLFNSTWFNSTWSTEGSNNTEGSDTITLPCRIKQI

********     440        450
                                      |
93Th057   INMWQGTGQAMYAPPIDGKINCVSNITGILLTRDGGAKNTSNETFRPGGG
HXBc2     INMWQKVGKAMYAPPISGQIRCSSNITGLLLTRDGGNSNNESEIFRPGGG
              β20/β21                              V5    β24

****  480        490
                   |          |
93Th057   NIKDNWRSELYKYKVVQIE
HXBc2     DMRDNWRSELYKYKVVKIE
```

FIG. 35A
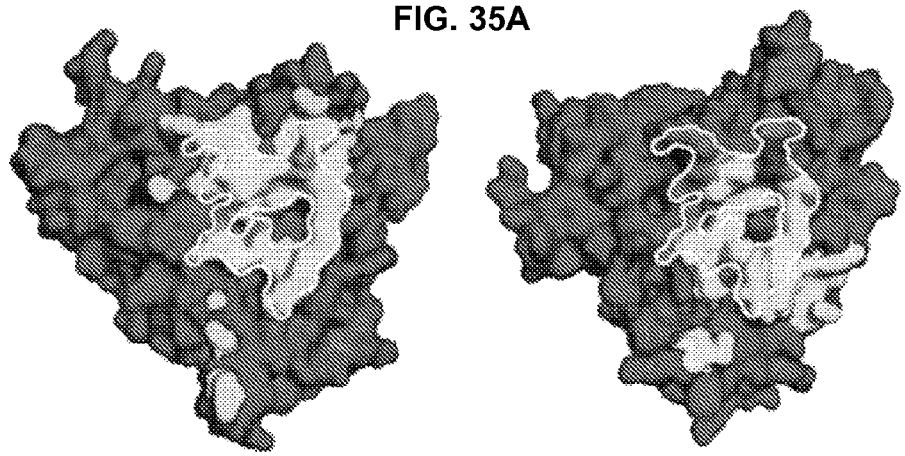
VRC01 coverage, 98%   b12 coverage, 83%
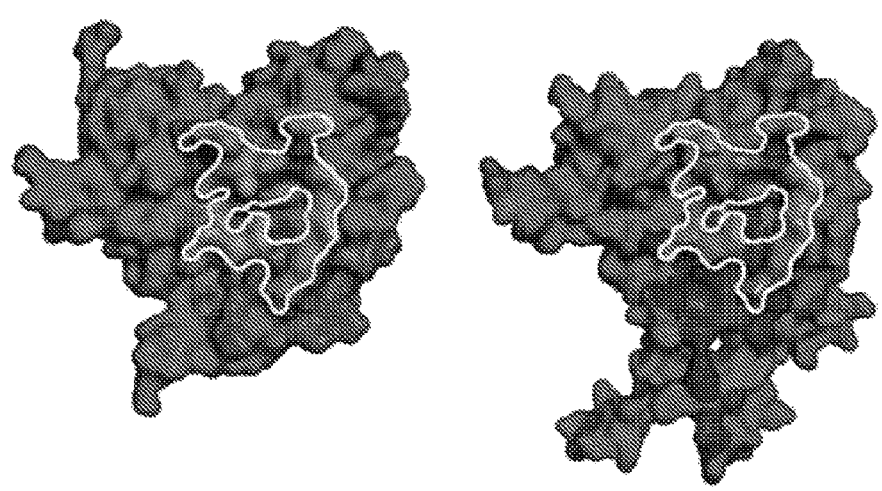
b13 coverage, 51%   F105 coverage, 79%
FIG. 35B
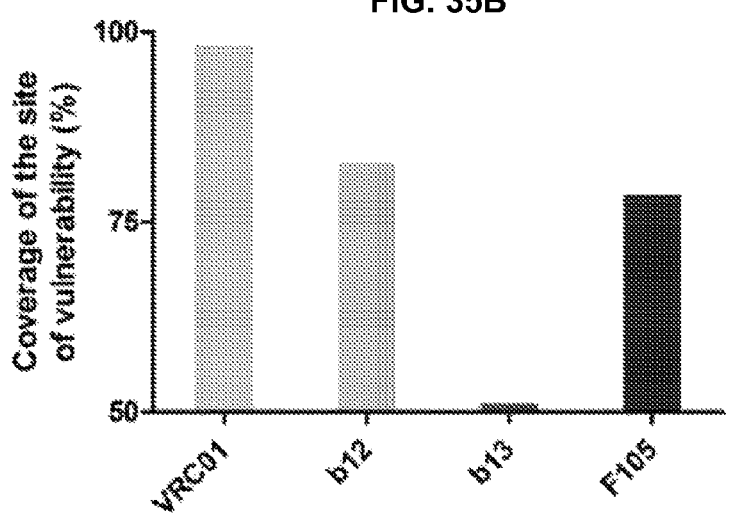

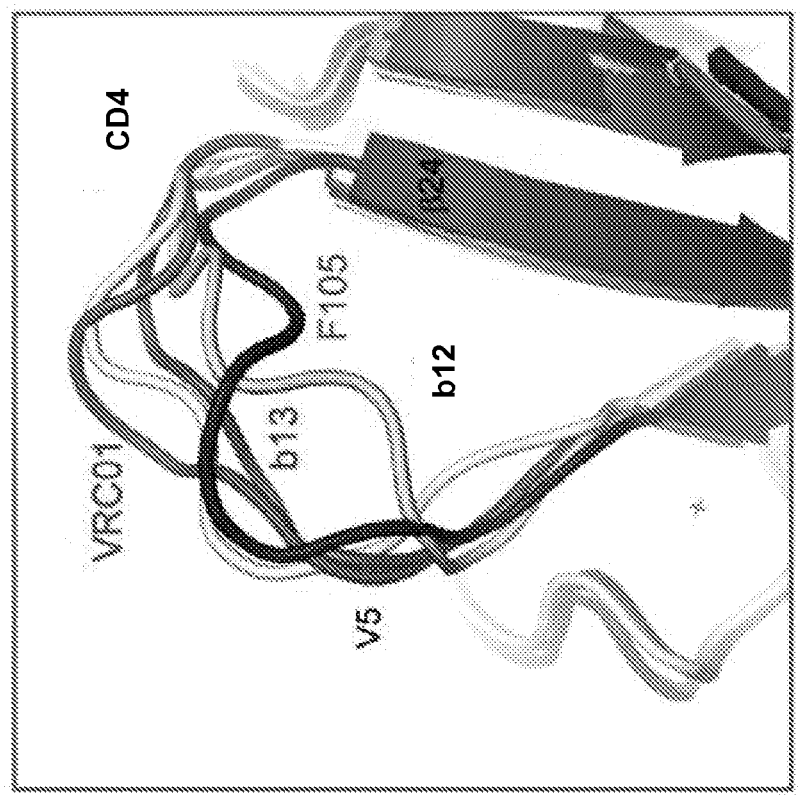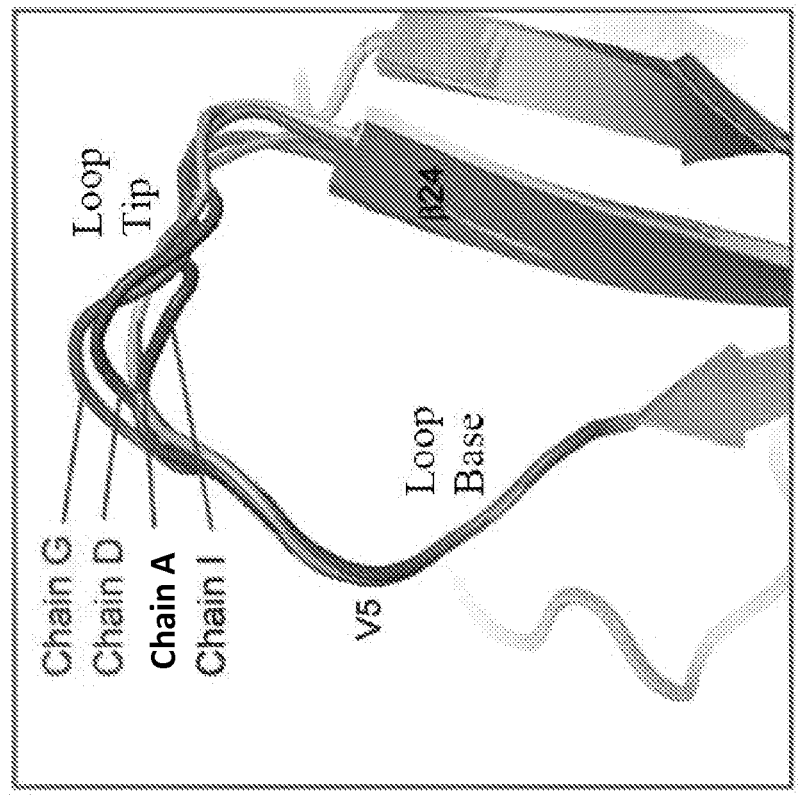
FIG. 37

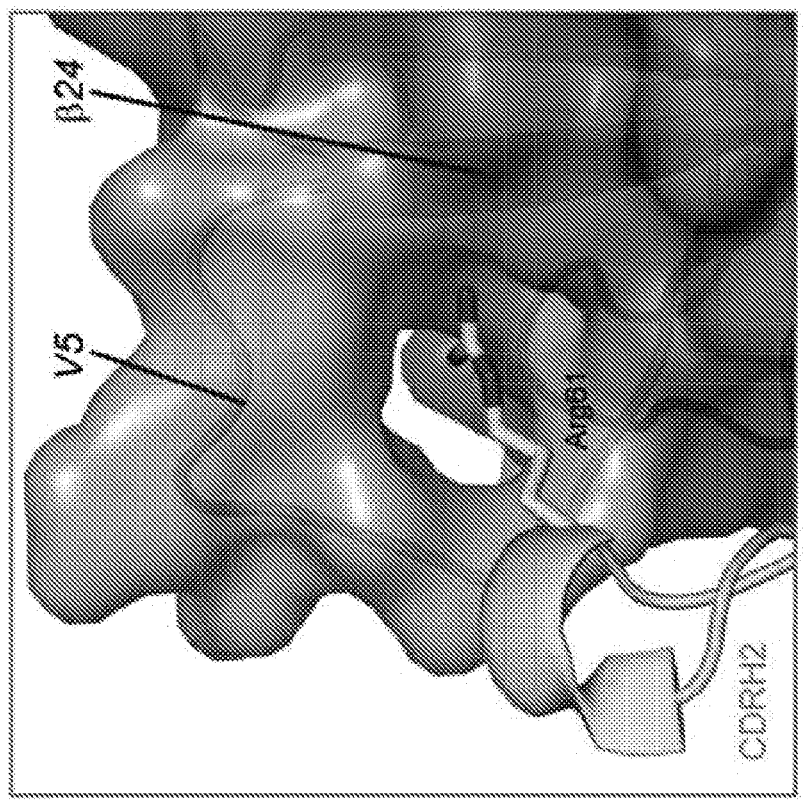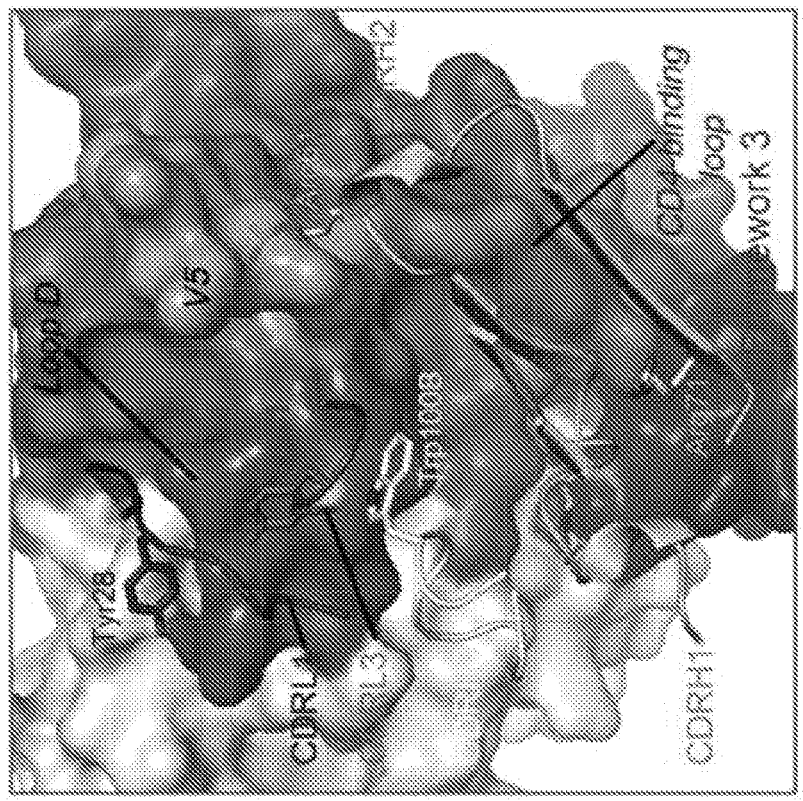
FIG. 39

FIG. 40

Heavy chain - variable domain

```
                    1          10         20         30         40         5052A
                    |          |          |          |          |          |||
                    ------FR1------------------------  -----CDR1-----  ------FR2------
IGHV1-02*02         QVQLVQSGAEVKKPGASVKVSCKASGYTFTGYYMHWVRQAPGQGLEWMGWINPNSGGTNY
VRC01               QVQLVQSGGQMKKPGESMRISCRASGYPFIDCTLNWIRLAPGKRFEWMGWLKPRYGAVNY 60         70         8082ABC    90         100ABCD    110
                    |          |          |||        |          ||||       |
                    ------FR3------------------------------------  ----CDR3----  ---FR4---
IGHV1-02*02         AQKFQGRVTMTRDTSISTAYMELSRLRSDDTAVYYCAR-----------YDYVWYFQHWGQGTLVTVS
VRC01               AQLFQGRVTMTRDVYSETAFLELRSLTSDDTAVYFCTRGKNCDYNWDFEHWGRGTPVTVS
```

Light chain - variable domain

```
                    1          10         20         30 33      40         50         60
                    |          |          |           | |       |          |          |
                    ------FR1------------------------  ----CDR1----  ------FR2------  ---CDR2---
IGKV3-11*01         EIVLTQSPATLSLSPGERATLSCRASQSVSSYLAWYQQKPGQAPRLLIYDASNRATGIPA
VRC01               EIVLTQSPGTLSLSPGETAIISCRTSQYGSLAWYQQRPGQAPRLVIYSGSTRAAGIPD 70         80         9196 100             110
                    |          |          ||| |               |
                    ------FR3------------------------  -----CDR3-----  ---FR4---
IGKV3-11*01         RFSGSGSGRDFTLTISSLEPEDFAVYYCQQ-----FGQGTKLEIK
VRC01               RFSGSRWGPDYNLTISNLESGDFGVYYCQQYEFFGQGTKVDIKRT
```

```
VRC01        QVQLVQSGGQMKKPGESMRISCRASGYEFIDCTLNWIRLAPGKRPEWMGWLKPRGGAVNY
IGHV1-2*02   ........AEV....A.VKV..K....T.TGYYMH.V.Q...QGL.....IN.NS.GT..
IGHV1-2*04   ........AEV....A.VKV..K....T.TGYYMH.V.Q...QGL.....IN.NS.GT..
IGHV1-2*03   ........AEV..L.A.VKV..K....T.TGYYMH.VXQ...QGL.....IN.NS.GT..
IGHV1-3*01   ........AEV....A.VKV..K....T.TSYAMH.V.Q...Q.L.....INAGN.NTK.
IGHV1-2*01   ........AEV....A.VKV..K....T.TGYYMH.V.Q...QGL.....RIN.NS.GT.
IGHV1-8*01   ........AEV....A.VKV..K....T.TSYDI..V.Q.T.QGL.....MN.NS.NTG.
IGHV1-3*02   ........AEV....A.VKV..K....T.TSYAMH.V.Q...Q.L.....SNAGN.NTK.
IGHV1-46*03  ........AEV....A.VKV..K....T.TSYYMH.V.Q...QGL....IIN.S..STS.
IGHV1-46*02  ........AEV....A.VKV..K....T.NSYYMH.V.Q...QGL....IIN.S..STS.
IGHV1-46*01  ........AEV....A.VKV..K....T.TSYYMH.V.Q...QGL....IIN.S..STS.

VRC01        ARPLQGRVTMTRDVYSDTAFLELRSLTVDDTAVYFCTR
IGHV1-2*02   .QKF.........TSIS..YM..SR.RS......Y.A.   200/293
IGHV1-2*04   .QKF..W......TSIS..YM..SR.RS......Y.A.   199/293
IGHV1-2*03   .QKF.........TSIS..YM..SR.RS......Y.A.   198/293
IGHV1-3*01   SQKF.....I...TSAS..YM..S..RSE.....Y.A.   196/293
IGHV1-2*01   .QKF.....S...TSIS..YM..SR.RS...V..Y.A.   196/293
IGHV1-8*01   .QKF........NTSIS..YM..S..RSE.....Y.A.   197/296
IGHV1-3*02   SQEF.....I...TSAS..YM..S..RSE.M...Y.A.   195/293
IGHV1-46*03  .QKF.........TSTS.VYM..S..RSE.....Y.A.   195/293
IGHV1-46*02  .QKF.........TSTS.VYM..S..RSE.....Y.A.   194/293
IGHV1-46*01  .QKF.........TSTS.VYM..S..RSE.....Y.A.   194/293
```

FIG. 44

```
VRC01        EIVLTQSPGTLSLSPGETALISCRTSQYG---SLAWYQQRPGQAPRLVIYSGSTRAAGIP
IGKV3-NL1*01 ........A........R.TL...A..SVSS-Y......K........L..GA....T...
IGKV3-11*01  ........A........R.TL...A..SVSS-Y......K........L..DA.N..T...
IGKV3-11*02  ........A........R.TL...A..SVSS-Y......K........L..DA.N..T...
IGKV3D-11*01 ........A........R.TL...A..CVSS-Y......K........L..DA.N..T...
IGKV3-20*01  .................R.TL...A..SVSSSY......K........L..GA.S..T...
IGKV3-NL2*01 ........A........R.TL...A..GVSS-Y......K........L..DA.S..T...
IGKV3-NL5*01 ........A........R.TL...A..SVSSSY......K........L..DA.S..T...
IGKV3D-20*01 ........A........R.TL..GA..SVSSSY......K..L.....L..DA.S..T...
IGKV3-NL4*01 ........A........R.TL...A..GVSS-N......K........L..DA.N..T...
IGKV3D-15*01 ...M....A...V....R.TL...A..SVSS-N......K........L..GA....T...

VRC01        DRFSGSRWGPDYNLTISNLESGDFGVYYCQQ
IGKV3-NL1*01 A.....GS.TEFT....S.Q.E..A.....X    218/268
IGKV3-11*01  A.....GS.T.FT....S..PE..A......   219/270
IGKV3-11*02  A.....GS.R.FT....S..PE..A......   218/270
IGKV3D-11*01 A.....GP.T.FT....S..PE..A......   217/270
IGKV3-20*01  ......GS.T.FT....R..PE..A......   219/274
IGKV3-NL2*01 A.....GP.T.FT....S..PE..A.....X   215/268
IGKV3-NL5*01 ......GS.T.FT....R..PE..A......   217/273
IGKV3D-20*01 ......GS.T.FT....R..PE..A......   217/274
IGKV3-NL4*01 A.....GP.T.FT....S..PE..A......   215/270
IGKV3D-15*01 A.....GS.TEFT....S.Q.E..A......   215/271
```

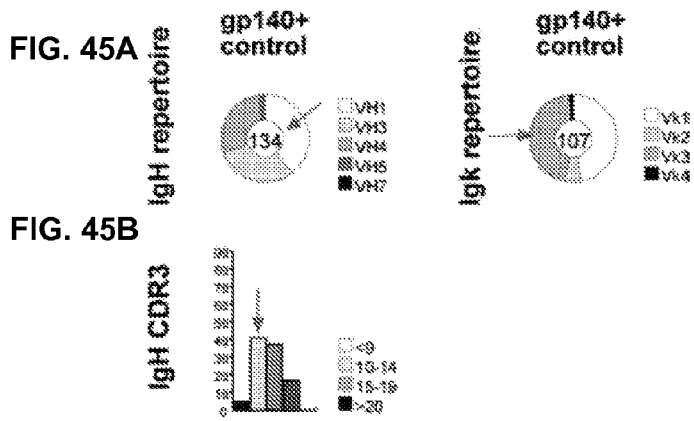
FIG. 45A
FIG. 45B
FIG. 45C
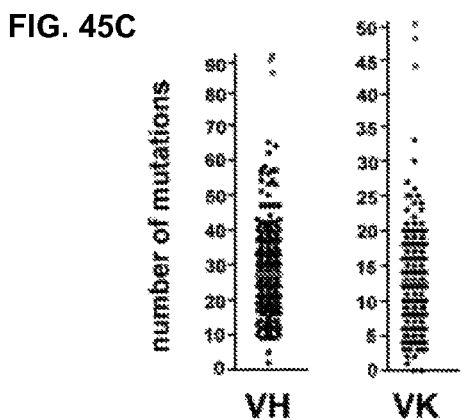
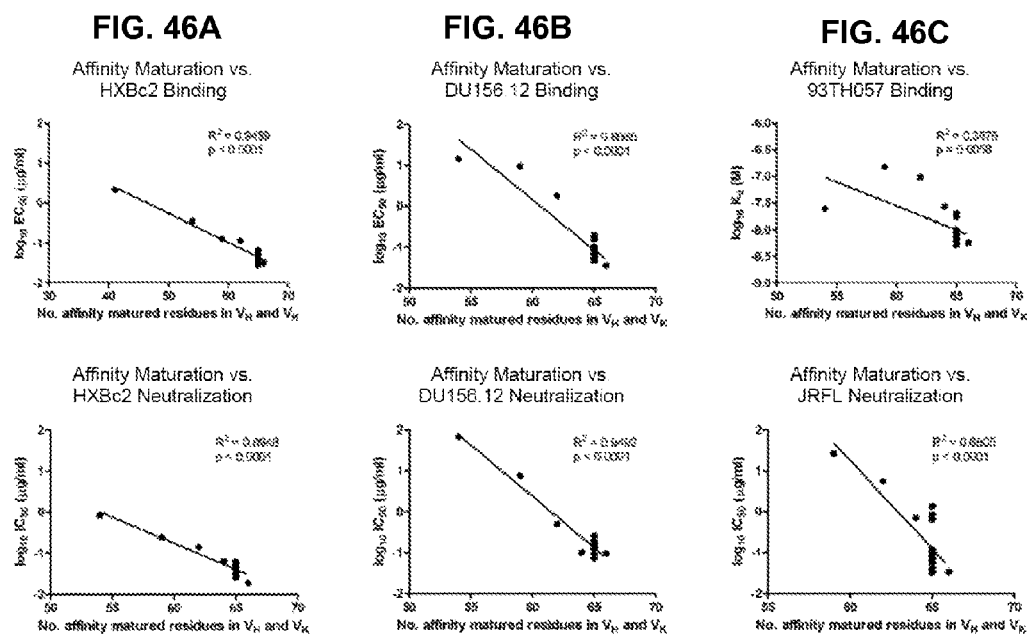
FIG. 46A  Affinity Maturation vs. HXBc2 Binding
FIG. 46B  Affinity Maturation vs. DU156.12 Binding
FIG. 46C  Affinity Maturation vs. 93TH057 Binding
FIG. 46D  Affinity Maturation vs. HXBc2 Neutralization
FIG. 46E  Affinity Maturation vs. DU156.12 Neutralization
FIG. 46F  Affinity Maturation vs. JRFL Neutralization

FIG. 47

Table S1. X-ray crystallographic data and refinement statistics for the antigen-binding fragment of VRC01 in complex with HIV-1 93TH057 gp120.

| Crystal | 93TH057-VRC01 |
|---|---|
| Data collection | |
| Space group | P21 |
| Wavelength, Å | 0.82656 |
| Unit cell dimensions | |
| a (Å) | 108.6 |
| b (Å) | 98.3 |
| c (Å) | 205.3 |
| α, β, γ (°) | 90.0, 99.7, 90.0 |
| Complexes per ASU | 4 |
| Resolution, Å | 2.9 |
| Completeness, %* | 94.8 (68.1) |
| Redundancy | 3.4 (1.9) |
| No. of total reflections | 307164 |
| No. of unique reflections | 90528 |
| $I/\sigma$* | 18.6 (1.2) |
| $R_{sym}$*,† | 8.0 (61.2) |
| Refinement statistics ($|F|>0\,\sigma$) | |
| Resolution, Å | 2.9 |
| $R_{work}/R_{free}$, %‡,§ | 19.7/25.6 |
| RMSD bond length, Å | 0.002 |
| RMSD bond angles, ° | 0.534 |
| Average B-factor, Å² | 57.3 |
| Ramachandran analysis | |
| Favored, % | 91.2 |
| Allowed, % | 99.1 |
| PDB ID | 3NGB |

* Values in parentheses are for the highest resolution shell.

† $R_{sym}=\Sigma|I-\langle I\rangle|/\Sigma\langle I\rangle$, where I is the observed intensity, and $\langle I\rangle$ is the average intensity of multiple observations of symmetry related reflections.

‡ $R=\Sigma_{hkl}||F_{obs}|-|F_{calc}||/\Sigma_{hkl}|F_{obs}|$

§ $R_{free}$ calculated from 5% of the reflections excluded from refinement.

Table S2. Contact areas at the interface of gp120 and VRC01.

| | Interface on VRC01 ($Å^2$) | | | | | | | Interface on gp120 ($Å^2$) |
|---|---|---|---|---|---|---|---|---|
| | N-term | CDR1 | FR2 | CDR2 | FR3 | CDR3 | Subtotal | |
| Heavy chain | 0 | 21 | 23 | 621 | 106 | 123 | 894 | 882 |
| Kappa chain | 38 | 123 | 0 | 0 | 0 | 190 | 351 | 367 |
| Total | | | | | | | 1245 | 1249 |

Table S3. gp120-contacting areas on heavy chains of CD4-binding site antibodies and CD4.

| Ligand | N-term ($Å^2$) | CDR1 ($Å^2$) | FR2 ($Å^2$) | CDR2 ($Å^2$) | FR3 ($Å^2$) | CDR3 ($Å^2$) | Total Area ($Å^2$) |
|---|---|---|---|---|---|---|---|
| F105 | 19 | 186 | 0 | 92 | 52 | 500 | 850 |
| b13 | 0 | 192 | 0 | 202 | 0 | 295 | 689 |
| b12 | 0 | 269 | 0 | 314 | 23 | 348 | 954 |
| CD4 | 0 | 82 | 221 | 528 | 240 | 11 | 1082 |
| VRC01 | 0 | 21 | 23 | 621 | 106 | 123 | 894 |

Color Key
<10%
10-20%
20-30%
30-40%
40-50%
>50%

FIG. 50

Table S4. Hydrogen bonds and salts bridges between gp120 and VRC01.

| Hydrogen bonds* | | | |
|---|---|---|---|
| VRC01 atom | | Dist. [Å] | gp120 atom |
| H:TRP | 50[ NE1] | 2.93 | G:ASN 280[ OD1] |
| H:LYS | 52[ NZ ] | 2.87 | G:ALA 281[ O ] |
| H:ASN | 58[ ND2] | 2.77 | G:ARG 456[ O ] |
| H:TYR | 59[ OH ] | 3.66 | G:SER 365[ O ] |
| H:ARG | 61[ N ] | 3.18 | G:GLY 458[ O ] |
| H:ARG | 61[ NH1] | 3.31 | G:ASN 465[ OD1] |
| H:ARG | 61[ NH1] | 3.01 | G:ASN 465[ O ] |
| H:ARG | 61[ NH1] | 2.86 | G:THR 467[ OG1] |
| H:ARG | 61[ NH2] | 3.54 | G:GLU 466[ OE2] |
| H:GLN | 64[ NE2] | 2.99 | G:ASP 457[ OD1] |
| H:ARG | 71[ NH1] | 3.10 | G:ASP 368[ OD2] |
| H:ARG | 71[ NH2] | 2.83 | G:ASP 368[ OD1] |
| H:TRP | 100B[ NE1] | 2.55 | G:ASN 279[ OD1] |
| H:GLY | 54[ O ] | 2.72 | G:ASP 368[ N ] |
| H:ASN | 58[ OD1] | 3.62 | G:GLY 458[ N ] |
| H:GLN | 64[ OE1] | 2.74 | G:ARG 469[ NH2] |
| H:ASP | 99[ O ] | 2.74 | G:LYS 282[ NZ ] |
| L:SER | 30[ OG ] | 2.93 | G:NAG 776[ O6 ] |
| L:SER | 30[ N ] | 3.36 | G:NAG 776[ O6 ] |
| L:TYR | 91[ OH ] | 3.19 | G:THR 278[ OG1] |
| L:GLU | 96[ OE2] | 3.44 | G:GLY 459[ N ] |
| Salt Bridges* | | | |
| VRC01 atom | | Dist. [Å] | gp120 atom |
| H:ARG | 61[ NH2] | 3.54 | G:GLU 466[ OE2] |
| H:ARG | 71[ NH1] | 3.59 | G:ASP 368[ OD1] |
| H:ARG | 71[ NH1] | 3.10 | G:ASP 368[ OD2] |
| H:ARG | 71[ NH2] | 2.83 | G:ASP 368[ OD1] |
| H:ARG | 71[ NH2] | 3.80 | G:ASP 368[ OD2] |
| H:ASP | 99[ OD1] | 3.80 | G:LYS 97[ NZ ] |

* Detailed gp120:VRC01 interface data was calculated on the EBI PISA server (http://www.ebi.ac.uk/msd-srv/prot_int/cgi-bin/piserver) (S20)

FIG. 51

Table S5. Structural comparison of VRC01-bound gp120 and gp120s in other crystalline lattices and bound by other ligands.

| Clade | Ligand(s) | PDB | Chain | $RMSD_{Com}$ (Å)[a] | $RMSD_{ID}$ (Å) | $RMSD_{OD}$ (Å) | $RMSD_{BS}$ (Å) |
|---|---|---|---|---|---|---|---|
| B (HXBc2) | CD4, 48d | 3JWO | A | 1.035 | 0.497 | 1.046 | 1.183 |
| B (HXBc2) | CD4, 48d | 3JWD | A/B | 1.039/1.033 | 0.494/0.572 | 1.068/1.089 | 1.191/1.287 |
| B (HXBc2) | CD4, 17b | 2NXY | A | 1.071 | 0.986 | 1.693 | 1.535 |
| B (HXBc2) | CD4, 17b | 2NXZ | A | 1.100 | 1.009 | 1.688 | 1.581 |
| B (YU2) | CD4, 412d | 2QAD | A/E | 1.103/1.104 | 1.203/1.210 | 1.393/1.156 | 1.264/1.297 |
| B (HXBc2) | CD4, 17b | 1G9M | G | 1.145 | 1.263 | 1.767 | 1.645 |
| B (HXBc2) | CD4, 17b | 1G9N | G | 1.147 | 1.091 | 1.875 | 1.811 |
| B (JR-FL) | CD4, X5 | 2B4C | G | 1.153 | 1.051 | 2.178 | 1.434 |
| B (YU2) | F23, 17b | 1YYM | G/P | 1.155/1.176 | 1.072/1.108 | 1.367/1.130 | 1.536/1.554 |
| B (HXBc2) | CD4, 17b | 1RZJ | G | 1.160 | 1.254 | 1.799 | 1.620 |
| B (YU2) | CD4, 17b | 1RZK | G | 1.160 | 1.105 | 1.893 | 1.793 |
| B (YU2) | CD4M33, 17b | 1YYL | G/P | 1.179/1.199 | 1.145/1.133 | 1.378/1.406 | 1.577/1.643 |
| B (YU2) | [Phe23]M47, 17b | 2I60 | G/P | 1.180/1.244 | 1.108/1.181 | 1.409/1.205 | 1.605/1.732 |
| B (YU2) | CD4M47, 17b | 2I5Y | G/P | 1.245/1.279 | 1.174/1.179 | 1.485/1.263 | 1.647/1.762 |
| B (HXBc2) | CD4, 17b | 1GC1 | G | 1.626 | 1.557 | 2.015 | 2.415 |
| C (CAP210) | CD4, 21c | 3LQA[b] | G | 2.197 | 1.282 | 2.995 | 1.831 |
| B (HXBc2) | b12 | 2NY7 | G | 4.113 | 4.667 | 3.617 | 9.877 |
| B (YU2) | F105 | 3HI1 | G/J | 4.515/4.557 | 2.599/2.572 | 5.689/5.763 | 20.051/19.990 |
| B (HXBc2) | b13 | 3IDX | G | 6.524 | 6.239 | 5.004 | 33.779 |
| SIV | — | 2BF1[b] | A | 8.583 | 10.202 | 7.899 | 18.535 |

[a] Cα-RMSDs of a set of common residues shared by all gp120s ($RMSD_{Com}$), of inner domain ($RMSD_{ID}$), of outer domain ($RMSD_{OD}$) and of bridging sheet ($RMSD_{BS}$) were calculated after each of the gp120 structures was superimposed with the VRC01-bound gp120 structure. The common set consists of 253 residues, including residues 90-120, 204-205, 215-298, 329-355, 357-392, 395, 413-469 and 473-489. The inner domain (ID) contains three segments, residues 90-118, 206-255 and 475-492. The outer domain (OD) contains three segments, residues 256-299, 330-394, 412-421 and 437-474. The bridging sheet contains two regions, residues 119-205 and 422-436.
[b] For 3LQA, which has adopted a different residue numbering, and 2BF1, which is the gp120 from SIV, sequence alignment with 1G9M is used to derive the standard HXBc2 numbering.

FIG. 52

Table S6. Recognition of HIV-1 gp120 by the CD4 receptor and CD4-binding-site reactive antibodies.

6a. Envelope overlapping between VH domains of antibodies and CD4 domain 1

| Domain | Volume ($Å^3$) | Combined Volume of VH and D1 ($Å^3$) | Overlapping of CD4 domain 1 |
|---|---|---|---|
| VRC01 | 15544.5 | 18958.07 | 73% |
| b12 | 16350.42 | 23490.12 | 43% |
| b13 | 16267.1 | 24879.65 | 31% |
| F105 | 15072.3 | 21700.42 | 47% |
| CD4 domain 1 | 12483.89 | - | 100% |

6b. Rotation angles between VH domains of antibodies and CD4 domain 1

|  | VRC01 | b12 | b13 | F105 | CD4 |
|---|---|---|---|---|---|
| VRC01 |  | 144.6 | 135.0 | 174.9 | 42.8 |
| b12 |  |  | 16.7 | 53.4 | 110.0 |
| b13 |  |  |  | 56.3 | 100.4 |
| F105 |  |  |  |  | 139.7 |
| CD4 |  |  |  |  |  |

The degree of envelope overlapping between two domains shows how much the two superimpose onto each other. To calculate the degree of envelope overlapping between CD4-binding site antibodies and CD4 as well as rotation angles between different gp120-bound ligands, gp120 complex structures were first aligned against gp120 outer domain in the gp120:VRC01 complex. The degree of envelope overlapping with CD4 was defined as $(Vol_{VH}+Vol_{D1}-Vol_{combi})/Vol_{D1}$, where $Vol_{VH}$ is the volume under the molecular surface of heavy chain variable domain of antibody, $Vol_{D1}$ is the volume under the molecular surface of domain 1 of CD4, $Vol_{combi}$ is volume under the molecular surface of combined coordinates of antibody heavy chain variable domain and CD4 domain 1 after gp120 outer domain alignment. The pair wise rotation angles between different gp120-bound antibodies were calculated by superposing their framework regions of both heavy and light chain variable domains in the outer-domain-aligned complexes. For comparison with CD4, only variable domain of heavy chain was used and the alignment was carried out as previously described (S27). It is obvious that VRC01 and CD4 have similar orientation of approaching to gp120 and have greater degree of envelope overlapping. All superposition were performed with CCP4 package (S7) and the molecular volume data were calculated with GRASP (S24).

FIG. 53

Table S7. Comparison of VRC01- and CD4-contacting areas on HIV-1 gp120.

| Ligand | Inner domain and Bridging sheet | LoopD+NAG | β-15/α-3 | V5 | β-24 | Outer domain exit-loop | Total |
|---|---|---|---|---|---|---|---|
| VRC01 (Å²) | 160 | 453 | 208 | 327 | 46 | 55 | 1249 |
| CD4 (Å²) | 356 | 228 | 253 | 154 | 14 | 81 | 1086 |

Breakdown of VRC01 epitope and CD4-binding site on gp120 indicates that VRC01 has less contact at the conformationally variable inner domain and bridging sheet, while it's interactions at the Loop D, V5 and β24 regions increase about 2-folds. This shift of binding pattern explains how VRC01 overcomes conformational masking to achieve broad and potent neutralization.

FIG. 54

Table S8. List of pdbs corresponding to the 26 human antibody complexes used in the analysis of antibody affinity maturation.

| PDB ID | Description | Similar PDBs |
|---|---|---|
| 1IQD | Human Factor VIII C2 Domain complexed to human monoclonal BO2C11 Fab (S28) | |
| 2DD8 | SARS-CoV Spike Receptor-Binding Domain Complexed with Neutralizing Antibody m396 (S29) | |
| 2GHW | SARS spike protein receptor binding domain in complex with a neutralizing antibody 80R (S30) | |
| 2NXY | HIV-1 gp120 Envelope Glycoprotein(S334A) Complexed with CD4 and Antibody 17b (S2) | 1G9M, 1G9N, 1GC1, 1RZJ, 1RZK, 2NXZ, 2NY0, 2NY1, 2NY2, 2NY3, 2NY4, 2NY5, 2NY6, 1YYL, 1YYM, 2I60 |
| 3G04 | TSH receptor in complex with a thyroid-stimulating autoantibody M22 (S31) | |
| 3GBM | Fab CR6261[1] in Complex with a H5N1 influenza virus hemagglutinin (S32) | 3GBN |
| 3IDX | HIV-gp120 core in complex with CD4-binding site antibody b13 (S3) | 3IDY |
| 3JWD | HIV-1 gp120 in complex with CD4 and Fab 48d (S33) | |
| 3H3P | HIV epitope-scaffold 4E10 Fv complex (S34) | 1TZG, 2FX7, 2FX8, 2FX9 |
| 3FKU | Influenza hemagglutinin (H5) in complex with a broadly neutralizing antibody F10 (S35) | |
| 3CSY | Trimeric prefusion Ebola virus glycoprotein in complex with neutralizing antibody KZ52 (S36) | |
| 1Q1J | Anti-HIV-1 Fab 447-52D in complex with V3 peptide (S37) | 3GHB, 3C2A |
| 1TJI | Broadly neutralizing anti-HIV-1 antibody 2F5 in complex with a gp41 17mer epitope (S38) | 3D0L, 3D0V, 3DRQ, 3DRT, 1TJG, 1TJH, 1U8H, 1U8I, 1U8J, 1U8K, 1U8L, 1U8M, 1U8N, 1U8O, 1U8P, 1U8Q, 1U91, 1U92, 1U93, 1U95, 2F5B, 3IDG, 3IDI, 3IDJ, 3IDM, 3IDN, 2P8L, 2P8M, 2P8P, 2PW1, 2PW2 |
| 2B1H | Anti-HIV-1 V3 Fab 2219 in complex with UG29 peptide (S39) | 2B1A, 2B0S |
| 3GHE | Anti-HIV-1 Fab 537-10D in complex with V3 peptide (S40) | |
| 3EYF | Anti-human cytomegalovirus antibody 8f9 plus gB peptide (S41) | |
| 2CMR | HIV-1 neutralizing antibody D5 Fab bound to the gp41 inner-core mimetic 5-helix (S42) | |
| 2NY7 | HIV-1 gp120 Envelope Glycoprotein Complexed with the Broadly Neutralizing CD4-Binding-Site Antibody b12 (S2) | |
| 2QAD | Tyrosine-sulfated 412d antibody complexed with HIV-1 YU2 gp120 and CD4 (S43) | |
| 2QSC | Anti-HIV-1 V3-Fab F425-B4e8 in complex with a V3-peptide (S44) | |
| 3B2U | Isolated domain III of the extracellular region of the epidermal growth factor receptor in complex with the Fab fragment of IMC-11F8 (S45) | 3B2V |
| 3H42 | PCSK9 in complex with from LDLR competitive antibody Fab (S46) | |
| 2B4C | HIV-1 JR-FL gp120 core protein containing the third variable region (V3) complexed with CD4 and the X5 antibody (S47) | |
| 3HI1 | HIV-1 gp120 (core with V3) in Complex with CD4-Binding-Site Antibody F105 (S3) | |
| 3LQA | Clade C gp120 in complex with sCD4 and 21c Fab (S48) | |
| 3LZF | Fab 2D1 in Complex with the 1918 Influenza Virus Hemagglutinin (S49) | |

[1] From IgM+ memory B cells

FIG. 55

Table S9. List of discarded pdbs from initial IMGT/PDB results

| Reason for Discarding | PDB ID(s) |
|---|---|
| not an antibody-protein or antibody-peptide complex | 1GPQ, 1GWD, 1H6M, 1H87, 1HC0, 1HNI, 1HNV, 1QE1, 1N8Y, 1S6P, 1S6Q, 1S9E, 1S9G, 1SUQ, 1SV5, 1UN3, 1UN4, 1UN5, 1UUZ, 1W0Y, 1W2K, 1W6Z, 1Y0L, 1Y16, 2B5J, 2BAN, 2BE2, 2BLX, 2BLY, 2BPU, 2C4F, 2C8O, 2C8P, 2CDE, 2CDF, 2CDG, 2CGI, 2I5Y, 2ITN, 2ITO, 2ITQ, 2ITT, 2ITU, 2ITV, 2ITW, 2ITY, 2ITZ, 2J5E, 2J5F, 2J6M, 2JB5, 2JB6, 2JIT, 2JIU, 2JIV, 2O5X, 2O5Y, 2O5Z, 2VB1, 2W1L, 2W1M, 2W1X, 2W1Y, 2WAR, 3BT0, 3BT1, 3CXF, 3D87, 3F00, 3F01, 3F02, 1CLY, 1FOR, 1GGB, 1GGC, 1H3T, 1H3U, 1H3V, 1H3W, 1H3X, 1HCV, 1JPT, 1K6Q, 1OL0, 1RHH, 1S5I, 1UCB, 2A6J, 2FJF, 3C08, 3CFJ, 3CFK, 3EYV, 3G6A, 3INU, 8FAB, 2WAH, 1CK0, 1TFH, 1RZG |
| non-human antibody | 2HFG, 2HH0, 2OSL, 3BKY, 3D85, 3IU3, 1C5B, 1C5C, 3HI6, 2H9G, 3EO1, 1BJ1, 1CZ8, 1S3K, 1S78, 2EH7, 2EH8, 3C09, 3EOA, 3IXT, 1YY9, 1TZH, 1TZI, 2QQN, 3GBW, 1A3R, 1AHW, 1E6J, 1E6O, 1F90, 1FE8, 1FPT, 1OCI, 1HYS, 2HMI, 1J50, 1KB5, 1MHH, 1N5Y, 1N6Q, 1N8Z, 1OAK, 1ROA, 1SY6, 1T03, 1V7M, 1V7N, 1YJD, 1YNT, 2ADF, 2AEP, 2AEQ, 2BDN, 2CKO, 2FD6, 2HKF, 2I5J, 2V17, 2VWE, 2ZCH, 2ZCK, 2ZCL, 2ZPK, 3BT2, 3CKO, 3CXD, 3DSF, 3FFD, 3IFL, 3IFN, 3IFO, 3IFP, 3KJ6, 1FNS, 1H0D, 1JRH, 1ACY, 1FGN, 1NAK, 2OR9, 2VXT, 3BSZ, 3G6J, 1LK3, 2ARJ, 3K2U, 2R0L, 2WUB, 1JPS, 1UJ3, 1I9R, 3BDY, 3BE1, 2FEE, 3G6D, 2VXS, 2FBD, 1ZA3, 2FJG, 2FJH, 2WUC, 2VYR, 3BN9, 3DVG, 3FN0, 3DVN, 2VDN, 1W72, 2VDP, 2VDQ |
| non-IgG antibody | 2F56, 1ADQ, 2J6E, 2VXQ, 1DEE, 1HEZ |
| modified antigenic target | 2OQJ, 1MCC, 1MCD, 1MCE, 1MCF, 1MCH, 1MCI, 1MCJ, 1MCK, 1MCL, 1MCN, 1MCQ, 1MCR, 1MCS, 1NDX, 1MCB |
| Fc fragment | 1FC2, 1OQO, 1OQX, 2IWG, 1FCC, 1DN2 |
| insufficient information | 2QQK, 2QQL, 2JIX, 2ZNW, 1NL0, 2ZNX, 3HOT, 3GJF, 3GJG, 3HAE |

The entire PDB was searched with the terms, "Human antibody complex", and results were combined with a search of the IMGT/3Dstructure-DB database. This resulted in a total of 332 pdb entries. These were manually examined for human IgG antibodies that had undergone natural affinity maturation and contained antibody-protein or antibody-peptide complexes. Antibody complexes that fit these criteria are listed in Table S8. Antibodies that did not fit these criteria are listed here, grouped into several categories. While some structures may have multiple reasons for discarding, a single reason is reported here. The 'Non-human antibody' category includes antibodies from other species, as well as humanized and chimeric antibodies, and antibodies subjected to artificial affinity maturation. The 'insufficient information' category includes structures for which sufficient evidence for inclusion in the analysis could not be identified. The 'modified antigenic target' category includes structures containing artificially-constructed or modified antigens for improved/altered binding to the antibody.

FIG. 56

Table S10a. Characterization by surface-plasmon resonance and ELISA of the interaction between gp120 and variants of VRC01 IgG.

| Mutant Number | Mutant category | SPR Kinetics for 93TH057 gp120 | | | EC50 (μg/ml)[a] | | | | Mutations or treatment |
|---|---|---|---|---|---|---|---|---|---|
| | | ka (M/s) | kd (s⁻¹) | KD (M) | 93TH057 | Stabilized HXBc2[b] | HXBc2 | Du156.12 | |
| 1 | | 4.24E+04 | 2.81E-04 | 6.64E-09 | 0.0631 | 0.0461 | 0.028 | 0.043 | Heavy chain: T33Y |
| 2 | | 1.79E+04 | 3.61E-04 | 2.02E-08 | 0.1501 | 0.0610 | 0.038 | 0.072 | Heavy chain: G54S |
| 3 | | 6.62E+04 | 3.47E-04 | 5.24E-09 | 0.1387 | 0.0565 | 0.093 | 0.191 | Heavy chain: A56G |
| 4 | | 2.70E+04 | 1.96E-04 | 7.27E-09 | 0.0515 | 0.0475 | 0.054 | 0.164 | Heavy chain: V57T |
| 5 | | 5.21E+04 | 4.44E-04 | 8.53E-09 | 0.0373 | 0.0350 | 0.038 | 0.066 | Heavy chain: P62K |
| 6 | Single interface revertant | 4.98E+04 | 3.78E-04 | 7.61E-09 | 0.0604 | 0.0309 | 0.088 | 0.097 | Heavy chain: V73T |
| 7 | | 3.40E+04 | 3.43E-04 | 1.01E-08 | 0.0419 | 0.0344 | 0.059 | 0.071 | Heavy chain: Y74S |
| 8 | | 4.79E+04 | 3.12E-04 | 6.52E-09 | 0.1135 | 0.0669 | 0.041 | 0.063 | Heavy chain: I30T |
| 9 | | 4.53E+04 | 3.50E-04 | 7.74E-09 | 0.0401 | 0.0480 | 0.038 | 0.056 | Heavy chain: K52N |
| 10 | | 7.06E+04 | 4.40E-04 | 6.23E-09 | 0.0308 | 0.2135 | 0.062 | 0.563 | Heavy chain: R53N |
| 11 | | 4.30E+04 | 2.92E-04 | 6.78E-09 | 0.0243 | 0.0674 | 0.037 | 0.086 | Heavy chain: S61Q |
| 12 | | 4.74E+04 | 8.20E-04 | 1.73E-08 | 0.0430 | 0.0552 | 0.038 | 0.196 | Light chain: Y39S |
| 13 | 4-revertant | 7225 | 7.02E-04 | 9.72E-08 | 0.2497 | 0.0665 | 0.114 | 1.80 | Heavy chain: A56G, V57T, P62K, V73T |
| 14 | 7-revertant | 3732 | 5.67E-04 | 1.52E-07 | 1.0780 | 0.0698 | 0.128 | 9.82 | Heavy chain: T33Y, G54S, A56G, V57T, P62K, V73T, Y74S |
| 15 | 12-revertant | 6.32E+03 | 1.56E-04 | 2.47E-08 | 0.3760 | 0.2829 | 0.348 | 14.33 | Heavy chain: I30T, K52N, R53N, G54S, A56G, V57T, S61Q, P62K, V73T, Y74S; Light chain: Y39S |
| 16 | C32A/C98S | 3.87E+04 | 3.45E-04 | 8.92E-09 | 0.0430 | 0.0586 | 0.047 | 0.043 | Heavy chain: C32S,C98A |
| 17 | Insertion-AA | 1.75E+04 | 5.81E-03 | 3.20E-07 | 1.2660 | 0.0420 | 0.238 | 2.02 | Light chain insertion AlaAla after position 30 |
| 18 | Insertion-SY | 1.83E+04 | 5.01E-04 | 2.74E-08 | 0.0026 | 0.0038 | ND[c] | ND | Light chain insertion SerTyr after position 30 |
| 19 | gHC+LC | ND | ND | ND | 2.2860 | 1.2080 | 21.38 | >50 | Germline VH and wild type Light chain |
| 20 | HC+gLC | ND | ND | ND | NBD[d] | 0.1094 | 3.14 | >50 | Germline VL and wild type heavy chain |
| 21 | gHC+gLC | | NBD | | NBD | | >50 | >50 | Both germline VH and VL gene |
| | Deglycosylated | 5.49E+04 | 1.36E-04 | 2.48E-09 | 0.0480 | 0.0430 | 0.045 | 0.050 | Enzyme deglycosylation to remove glycans |
| Wild Type | VRC01 | 3.83E+04 | 2.20E-04 | 5.76E-09 | 0.0355 | 0.0350 | 0.032 | 0.037 | |

[a]: ELISA experiments for 93TH057 and stabilized HXBc2 core gp120 were performed in different format from that of HXBc2 and Du156.12. The former ones were carried out in triplicates and the latter ones were performed without duplication.
[b]: HXBc2 core Ds12F123 with mutations to stabilize the gp120 in its CD4-bound conformation.
[c]: ND: constants not determined
[d]: NBD: No binding detected

FIG. 57

Table S10b. Neutralization IC50 values (µg/ml) of VRC01 variants against three HIV-1 primary isolates and the lab strain HXB2.

| Mutant Number | Mutant Category | Q842.d12 (clade A) | | JRFL (clade B) | | Du156.12 (clade C) | | HXB2 (clade B) | | Mutations or treatment |
|---|---|---|---|---|---|---|---|---|---|---|
| | | Mean[a] | SEM[a] | Mean[a] | SEM[a] | Mean[a] | SEM[a] | Mean[a] | SEM[a] | |
| 1 | Single interface revertant | 0.028 | 0.003 | 0.041 | 0.003 | 0.125 | 0.002 | 0.046 | 0.001 | Heavy chain: T33Y |
| 2 | | 0.026 | 0.001 | 0.077 | 0.003 | 0.129 | 0.009 | 0.049 | 0.004 | Heavy chain: G54S |
| 3 | | 0.028 | 0.002 | 0.064 | 0.003 | 0.169 | 0.024 | 0.045 | 0.003 | Heavy chain: A56G |
| 4 | | 0.028 | 0.002 | 0.850 | 0.076 | 0.148 | 0.039 | 0.054 | 0.000 | Heavy chain: V57T |
| 5 | | 0.022 | 0.001 | 0.033 | 0.002 | 0.072 | 0.003 | 0.029 | 0.003 | Heavy chain: P62K |
| 6 | | 0.040 | 0.000 | 0.095 | 0.004 | 0.196 | 0.026 | 0.056 | 0.002 | Heavy chain: V73T |
| 7 | | 0.045 | 0.003 | 0.119 | 0.008 | 0.261 | 0.046 | 0.047 | 0.004 | Heavy chain: Y74S |
| 8 | | 0.030 | 0.001 | 0.059 | 0.006 | 0.153 | 0.049 | 0.027 | 0.005 | Heavy chain: I30T |
| 9 | | 0.027 | 0.002 | 0.088 | 0.002 | 0.090 | 0.005 | 0.031 | 0.002 | Heavy chain: K52N |
| 10 | | 0.040 | 0.003 | 0.659 | 0.037 | 0.132 | 0.016 | 0.063 | 0.007 | Heavy chain: R53N |
| 11 | | 0.024 | 0.003 | 0.062 | 0.012 | 0.171 | 0.037 | 0.026 | 0.0003 | Heavy chain: R61Q |
| 12 | | 0.034 | 0.001 | 1.36 | 0.184 | 0.135 | 0.019 | 0.043 | 0.003 | Light chain: Y28S |
| 13 | 4-revertant | 0.080 | 0.002 | 5.62 | 0.579 | 0.504 | 0.035 | 0.142 | 0.008 | Heavy chain: A56G, V57T, P62K, V73T |
| 14 | 7-revertant | 0.263 | 0.011 | 26.5 | 2.959 | 7.63 | 1.344 | 0.244 | 0.009 | Heavy chain: T33Y, G55S, A56G, V57T, P62K, V73T, Y74S |
| 15 | 12-revertant | 0.380 | 0.006 | >200 | NA | 67.7 | 3.655 | 0.850 | 0.122 | Heavy chain: I30T, K52N, R53N, G54S, A56G, V57T, R61Q, P62K, V73T, Y74S; Light chain: Y28S |
| 16 | C32SC98A | 0.027 | 0.003 | 0.057 | 0.002 | 0.123 | 0.043 | 0.033 | 0.004 | Heavy chain: C32S,C98A |
| 17 | Insertion-AA | 0.319 | 0.026 | 2.68 | 0.369 | 5.02 | 1.741 | 2.442 | 1.091 | Light chain insertion AlaAla after position 30 |
| 18 | Insertion-SY | 0.023 | 0.001 | 0.721 | 0.135 | 0.102 | 0.007 | 0.064 | 0.002 | Light chain insertion SerTyr after position 30 |
| 19 | gHC+LC | >500 | NA | >500 | NA | >500 | NA | >500 | NA | Germline VH and wild type light chain |
| 20 | HC+gLC | >500 | NA | >500 | NA | >500 | NA | >500 | NA | Germline VL and wild type heavy chain |
| 21 | gHC+gLC | >500 | NA | >500 | NA | >500 | NA | >500 | NA | Both germline VH and VL gene |
| 22 | Deglycosylated | 0.028 | 0.002 | 0.031 | 0.002 | 0.059 | 0.003 | 0.022 | 0.002 | Enzyme deglycosylation to remove glycans |
| Wild Type | VRC01 | 0.028 | 0.002 | 0.034 | 0.004 | 0.096 | 0.013 | 0.019 | 0.003 | |

[a]: Mean and SEM were calculated from three independent experiments; NA: not applicable Table S11. Correlations between binding and neutralization data for VRC01 variants and panels of gp120 and HIV-1 isolates.

FIG. 58

| | $K_d$ (93TH057) | $EC_{50}$ (93TH057) | $EC_{50}$ (Stabilized HXB.2) | $EC_{50}$ (HXB.2) | $IC_{50}$ (Du156.12) | $IC_{50}$ (HXB.2) | $IC_{50}$ (Q842.d12) | $IC_{50}$ (JRFL) | $IC_{50}$ (Du156.12) |
|---|---|---|---|---|---|---|---|---|---|
| $K_d$ (93TH057) | | 0.7178 | | | | | | | |
| $EC_{50}$ (93TH057) | | | [red] | 0.5093 | 0.6444 | 0.6738 | 0.5923 | 0.6675 | 0.4563 |
| $EC_{50}$ (Stabilized HXB.2) | | | | 0.627 | 0.7025 | 0.7213 | 0.7192 | 0.4483 | 0.6354 |
| $EC_{50}$ (HXB.2) | | | | | 0.2432 | 0.2106 | [red] | [red] | 0.26 |
| $IC_{50}$ (Du156.12) | | | | | | 0.8162 | 0.8584 | 0.8888 | 0.5898 | 0.851 |
| $IC_{50}$ (HXB.2) | | | | | | | 0.7347 | 0.8738 | 0.8348 | 0.8756 |
| $IC_{50}$ (Q842.d12) | | | | | | | | 0.8572 | 0.5223 | 0.7742 |
| $IC_{50}$ (JRFL) | | | | | | | | | 0.588 | 0.9192 |
| $IC_{50}$ (Du156.12) | | | | | | | | | | 0.5796 |

Correlations (from linear regression analysis) were obtained for all pairs of binding and neutralization data. $R^2$ values are shown colored by p-values: red for $p > 0.05$, yellow for $0.01 < p < 0.05$, and white for $p < 0.01$. Germline variants were not included in the correlation analysis since precise data were not available for the majority of the experiments.

FIG. 59

Table S12. Interactions between heavy chain of VRC01 and gp120.

| | Interface residue | Bond Type* | ASA* | BSA* | Δ¹G |
|---|---|---|---|---|---|
| Heavy Chain | H:ILE 30 | | 65.14 | 17.92 | 0.29 |
| | H:THR 33 | | 27.12 | 2.62 | 0.03 |
| | H:TRP 47 | | 67.02 | 23.16 | 0.37 |
| | H:TRP 50 | H | 45.64 | 41.10 | 0.30 |
| | H:LYS 52 | H | 80.95 | 40.21 | -1.16 |
| | H:ARG 53 | | 151.61 | 62.69 | 0.02 |
| | H:GLY 54 | H | 69.07 | 53.07 | 0.07 |
| | H:GLY 55 | | 20.23 | 17.16 | -0.06 |
| | H:ALA 56 | | 49.64 | 33.08 | 0.52 |
| | H:VAL 57 | | 52.88 | 40.45 | 0.24 |
| | H:ASN 58 | H | 67.15 | 65.13 | -0.53 |
| | H:TYR 59 | H | 51.57 | 36.62 | 0.19 |
| | H:ALA 60 | | 12.55 | 10.71 | 0.17 |
| | H:ARG 61 | HS | 209.87 | 154.87 | -0.77 |
| | H:PRO 62 | | 106.31 | 18.74 | 0.30 |
| | H:GLN 64 | H | 104.46 | 47.50 | -0.65 |
| | H:MET 69 | | 6.86 | 0.08 | -0.01 |
| | H:ARG 71 | HS | 71.23 | 25.47 | -0.71 |
| | H:VAL 73 | | 94.83 | 23.26 | 0.37 |
| | H:TYR 74 | | 212.55 | 57.27 | 0.64 |
| | H:ASP 99 | HS | 131.87 | 47.84 | -0.13 |
| | H:TYR 100 | | 116.82 | 19.39 | 0.31 |
| | H:ASN 100A | | 23.19 | 13.03 | 0.14 |
| | H:TRP 100B | H | 114.38 | 42.37 | 0.12 |
| gp120 | G:LYS 97 | S | 146.38 | 29.09 | -1.04 |
| | G:THR 123 | | 47.04 | 0.16 | 0.00 |
| | G:GLY 124 | | 76.25 | 39.85 | 0.54 |
| | G:GLY 198 | | 90.93 | 12.42 | -0.11 |
| | G:ASN 279 | H | 63.04 | 39.40 | -0.34 |
| | G:ASN 280 | H | 67.85 | 41.03 | -0.46 |
| | G:ALA 281 | H | 85.48 | 74.66 | 0.73 |
| | G:LYS 282 | H | 68.01 | 30.24 | -0.71 |
| | G:SER 365 | H | 98.84 | 64.53 | 0.31 |
| | G:GLY 366 | | 43.38 | 23.29 | 0.15 |
| | G:GLY 367 | | 58.12 | 21.26 | 0.27 |
| | G:ASP 368 | HS | 73.72 | 49.32 | -0.46 |
| | G:ILE 371 | | 56.48 | 49.29 | 0.79 |
| | G:TRP 427 | | 56.37 | 10.66 | -0.12 |
| | G:GLN 428 | | 36.47 | 0.37 | -0.08 |
| | G:GLY 429 | | 45.93 | 6.93 | 0.11 |
| | G:THR 430 | | 118.00 | 57.89 | 0. |
| | G:THR 455 | | 59.80 | 35.29 | 0.51 |
| | G:ARG 456 | H | 29.79 | 3.83 | -0.04 |
| | G:ASP 457 | H | 50.53 | 48.22 | 0.14 |
| | G:GLY 458 | H | 50.68 | 44.48 | -0.22 |
| | G:GLY 459 | | 87.35 | 37.81 | 0.40 |
| | G:ALA 460 | | 75.49 | 28.45 | 0.22 |
| | G:THR 463 | | 53.37 | 16.26 | 0.20 |
| | G:ASN 465 | H | 39.19 | 6.74 | -0.10 |
| | G:GLU 466 | HS | 21.07 | 6.56 | -0.07 |
| | G:THR 467 | H | 24.23 | 11.16 | -0.13 |
| | G:ARG 469 | H | 46.99 | 21.29 | -0.53 |
| | G:GLY 472 | | 16.47 | 7.83 | -0.09 |
| | G:GLY 473 | | 42.85 | 27.54 | -0.06 |
| | G:ASP 474 | | 66.09 | 19.18 | -0.02 |
| | G:LYS 476 | | 60.24 | 3.72 | -0.03 |

\* Bond type: H: Hydrogen, D Disulphide bond, S: Salt bridge C: Covalent link
ASA Accessible Surface Area, Å²
BSA Buried Surface Area, Å²
Δ¹G Solvation energy effect, kcal/mol
||| Buried area percentage, one bar per 10%
Detailed gp120:VRC01 interface data was calculated on the EBI PISA server
(http://www.ebi.ac.uk/msd-srv/prot_int/cgi-bin/piserver) (S29)

FIG. 60

Table S13. Interactions between light chain of VRC01 and gp120.

| | Interface residue | Bond type* | ASA* | BSA* | $\Delta^i G$ |
|---|---|---|---|---|---|
| Light chain | L:VAL 3 | | 117.89 | 37.56 ||| | 0.07 |
| | L:GLN 27 | | 124.49 | 24.67 || | -0.15 |
| | L:TYR 28 | | 186.13 | 77.44 ||||| | 0.39 |
| | L:GLY 29 | | 20.70 | 4.89 ||| | 0.08 |
| | L:SER 30 | H | 71.56 | 19.97 ||| | -0.03 |
| | L:TYR 91 | H | 130.33 | 80.71 |||||||| | 0.60 |
| | L:GLU 96 | | 126.90 | 58.83 |||||| | -0.30 |
| | L:PHE 97 | | 102.41 | 50.10 ||||| | 0.80 |
| gp120 | G:ASN 276 | | 85.13 | 24.64 ||| | -0.26 |
| | G:THR 278 | H | 121.24 | 83.13 |||||||| | 0.60 |
| | G:ASN 279 | | 63.04 | 23.64 ||| | 0.17 |
| | G:ASN 280 | | 67.85 | 26.83 ||| | -0.31 |
| | G:ARG 456 | | 29.79 | 1.91 | | -0.06 |
| | G:GLY 458 | | 50.68 | 5.28 || | 0.08 |
| | G:GLY 459 | H | 87.35 | 31.46 |||| | -0.04 |
| | G:ALA 460 | | 75.49 | 9.01 || | -0.03 |
| | G:ASN 461 | | 152.02 | 65.92 |||||| | 0.06 |
| | G:NAG 776 | H | 349.97 | 96.51 ||| | -1.92 |

\* Bond type: H: Hydrogen, D Disulphide bond, S: Salt bridge C: Covalent link
ASA Accessible Surface Area, Å²
BSA Buried Surface Area, Å²
$\Delta^i G$ Solvation energy effect, kcal/mol
||| Buried area percentage, one bar per 10%

Detailed gp120:VRC01 interface data was calculated on the EBI PISA server (http://www.ebi.ac.uk/msd-srv/prot_int/cgi-bin/piserver) (S20)

Table S14. Neutralization by VRC01 and CD4-Ig against a panel of 190 Env pseudoviruses representing all major circulating clades of HIV-1.

FIG. 61

| Virus clade | Number of viruses | Measured by $IC_{80} < 50$ μg/ml | | Measured by $IC_{80} < 1$ μg/ml | |
|---|---|---|---|---|---|
| | | VRC01 | CD4-Ig | VRC01 | CD4-Ig |
| A | 22 | 95% | 55% | 77% | 14% |
| B | 49 | 94% | 63% | 39% | 12% |
| C | 38 | 82% | 68% | 37% | 8% |
| D | 8 | 75% | 88% | 25% | 25% |
| CRF01_AE | 18 | 83% | 56% | 17% | 0% |
| CRF02_AG | 16 | 75% | 75% | 38% | 6% |
| G | 10 | 90% | 60% | 50% | 0% |
| CRF07_BC | 11 | 91% | 91% | 18% | 0% |
| Other | 18 | 78% | 61% | 67% | 0% |
| Total | 190 | 86% | 66% | 42% | 8% |

\* Data from Wu et al (S4)

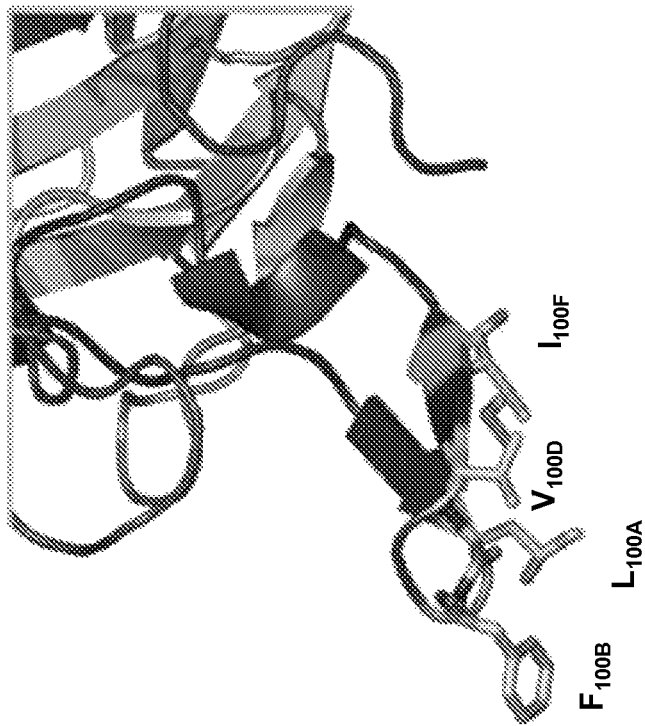
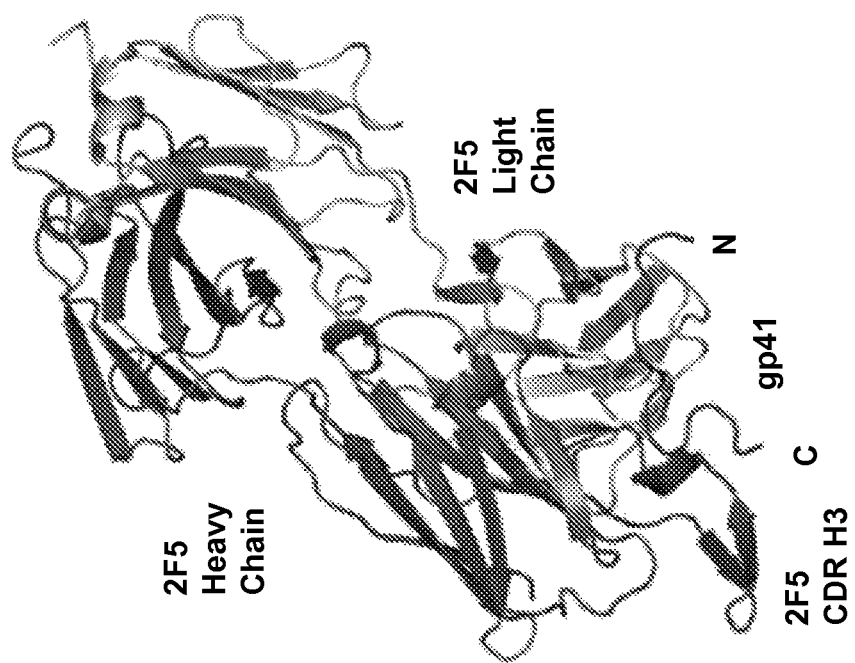
FIG. 62B
FIG. 62A

FIG. 63

TABLE 1. 2F5 CDR H3 partition free energies, binding constants to gp41 peptide, and neutralization $IC_{50}$s[e]

| MAb | Partition free energy | | gp41 MPER binding constants | | | Neutralization $IC_{50}$[a] | | | | | | | | |
|---|---|---|---|---|---|---|---|---|---|---|---|---|---|---|
| | $\Delta G_{wif}$[b,c] (kcal/mol) | $\Delta G_{oct}$[b,d] (kcal/mol) | ka (1/Ms $10^5$) | kd (1/s $10^{-3}$) | $K_D$ (M $10^{-9}$) | MN | HxB2 | 7312a-C1 | SC-422.8 | JR-FL | RHPA-4259 | TRO.11 | 7312a | MuLV |
| 2F5 wt | -1.47 | -3.25 | 8.06±0.04 | 7.64±0.04 | 9.5±0.1 | 0.0020 | 0.020 | 0.020 | 1.0 | 1.6 | 1.4 | >500 | >500 | >500 |
| $L100_AS$ | -0.78 | -1.54 | 9.5±0.1 | 10.2±0.1 | 10.8±0.2 | 2.1 | 2.5 | 8.8 | 61 | 440 | 120 | >500 | >500 | >500 |
| $F100_BS$ | -0.210 | -1.08 | 9.1±0.1 | 10.8±0.1 | 11.9±0.2 | 9.3 | 11 | 38 | >500 | >500 | >500 | >500 | >500 | >500 |
| $V100_DS$ | -1.41 | -2.33 | 1.26±0.03 | 18.0±0.4 | 14.3±0.4 | 0.10 | 0.30 | 0.70 | 34 | 120 | >500 | >500 | >500 | >500 |
| $I100_FS$ | -1.03 | -1.67 | 5.67±0.04 | 15.5±0.1 | 27.3±0.2 | 0.02 | 2.3 | 8.0 | 43 | 450 | 290 | >500 | >500 | >500 |
| $L100_AS$ $F100_BS$ | 0.480 | 0.630 | 8.91±0.04 | 9.73±0.03 | 10.9±0.1 | >500 | >500 | >500 | >500 | >500 | >250 | >250 | >500 | >500 |
| $L100_AS$ $V100_DS$ | -0.720 | -0.620 | 4.42±0.01 | 16.2±0.1 | 36.7±0.2 | >500 | >500 | >500 | >500 | >500 | >500 | >500 | nd | 240 |
| $F100_BS$ $I100S_F$ | 0.230 | 0.500 | 4.08±0.02 | 19.1±0.1 | 46.9±0.2 | >500 | >500 | >500 | >500 | >500 | >500 | >500 | nd | >500 |
| $L100_AW$ | -2.76 | -4.09 | 6.78±0.02 | 7.70±0.03 | 11.3±0.1 | 0.0010 | 0.015 | 0.015 | 0.10 | 0.50 | 0.90 | 210 | >500 | >500 |
| $F100_BW$ | -2.19 | -3.63 | 6.20±0.01 | 6.95±0.02 | 11.2±0.1 | 0.0010 | 0.030 | 0.020 | 0.40 | 1.6 | 1.0 | >250 | >500 | >500 |
| $V100_DW$ | -3.39 | -4.88 | 5.64±0.01 | 6.72±0.02 | 11.9±0.1 | 0.00020 | 0.0060 | 0.0080 | 0.040 | 0.10 | 0.20 | >250 | >500 | >500 |
| $L100_AW$ $V100_DW$ | -4.68 | -5.72 | 5.64±0.02 | 7.20±0.03 | 12.8±0.1 | 0.00030 | 0.0030 | 0.0050 | 0.10 | 0.50 | 0.40 | >500 | >500 | >500 |
| 1D4 wt | na | na | No binding detected | | | nd | >500 | >500 | >500 | >500 | >500 | >500 | >500 | >500 |

[a] $IC_{50}$ of ≤0.01 μg/ml (red), 0.01 to 1 μg/ml (yellow), ≥1 μg/ml (green).
[b] Calculated for residues $100_A$ to $100_F$ of the 2F5 CDR H3 loop.
[c] Wimley-White free energy of transfer, bilayer interface.
[d] Wimley-White free energy of transfer, octanol.
[e] na, not applicable; nd, not determined.

FIG. 64
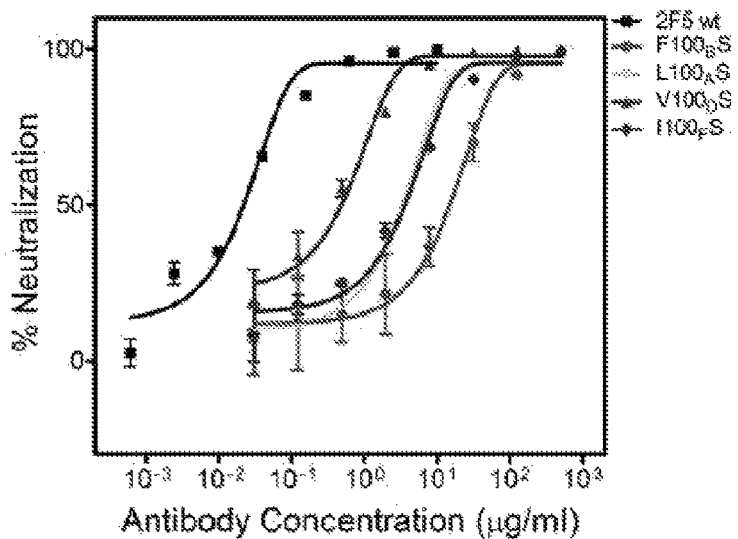
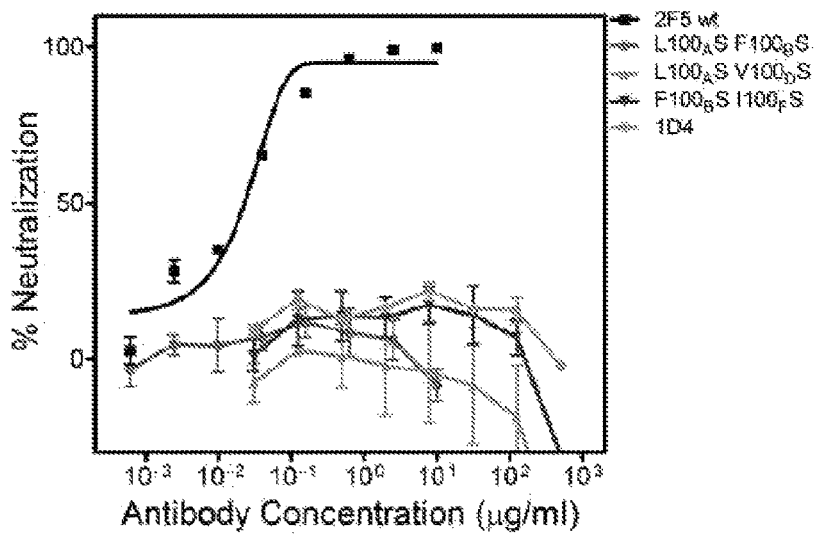
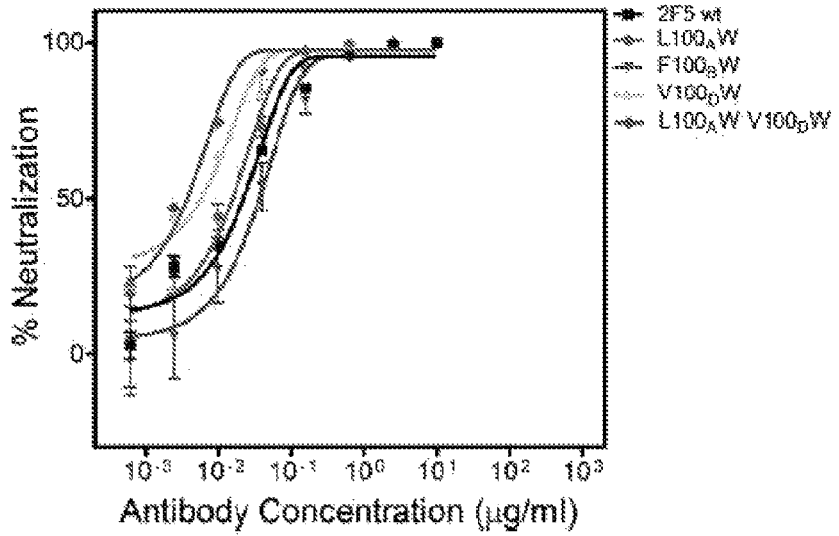

FIG. 66

TABLE 2. Linear correlation statistics of neutralization $IC_{50}$ and $\Delta\Delta G^N$ versus $\Delta G_{wt}$ and $K_D$ gp41 peptide[a]

| Strain | Neutralization $IC_{50}$ vs.: | | | | | | | | | | | | $\Delta\Delta G^N$ vs. $\Delta G_{wt}$ 2F5 CDR H3 $100_X$–$100_F$ | | | | | |
|---|---|---|---|---|---|---|---|---|---|---|---|---|---|---|---|---|---|---|
| | $\Delta G_{wt}$ 2F5 CDR H3 $100_X$–$100_F$ | | | | | | $K_D$ gp41 peptide | | | | | | | | | | | |
| | Slope | Error (±) | y intercept (log [μg/ml]) | Error (±) (log [μg/ml]) | $r^2$ | P | Slope | Error (±) | y intercept (log [μg/ml]) | Error (±) (log [μg/ml]) | $r^2$ | P | Slope | Error (±) | y intercept (kcal/mol) | Error (±) (kcal/mol) | $r^2$ | P |
| MN | 1.0 | 0.3 | 0.1 | 0.6 | 0.70 | 0.0048 | 0.02 | 0.12 | −2.1 | 1.7 | 0.0023 | 0.90 | 1.5 | 0.3 | 4.3 | 0.8 | 0.78 | 0.0037 |
| HxB2 | 0.8 | 0.2 | 0.7 | 0.4 | 0.80 | 0.0012 | 0.1 | 0.1 | −2.1 | 1.2 | 0.12 | 0.36 | 1.2 | 0.2 | 3.7 | 0.4 | 0.92 | 0.0002 |
| 7312a-C1 | 0.9 | 0.2 | 1.1 | 0.5 | 0.73 | 0.0034 | 0.1 | 0.1 | −2.2 | 1.4 | 0.15 | 0.31 | 1.4 | 0.2 | 4.4 | 0.6 | 0.86 | 0.001 |
| SC422.8 | 0.8 | 0.2 | 2.0 | 0.6 | 0.71 | 0.0084 | 0.1 | 0.1 | −1.3 | 1.2 | 0.20 | 0.26 | 1.3 | 0.3 | 3.2 | 0.8 | 0.78 | 0.0094 |
| JR-FL | 0.9 | 0.3 | 2.7 | 0.7 | 0.63 | 0.018 | 0.1 | 0.1 | −1.1 | 1.2 | 0.28 | 0.18 | 1.4 | 0.4 | 4.1 | 0.9 | 0.75 | 0.012 |
| RHPA-4259 | 0.6 | 0.4 | 1.8 | 1.0 | 0.41 | 0.17 | na | na | na | na | na | na | 1.1 | 0.6 | 3.3 | 1.7 | 0.56 | 0.15 |
| Overall | | | | | | | | | | | | | 1.3 | 0.1 | 4.0 | 0.3 | 0.78 | <0.0001 |

[a] Quadratic correlations are shown in Fig. 4.

FIG. 69

TABLE S1. Linear Correlation Statistics of Neutralization $IC_{50}$ and $\Delta\Delta G^N$ vs. $\Delta G_{oct}$.

| | Neutralization $IC_{50}$ vs. $\Delta G_{oct}$ 2F5 CDR H3 $100_A$-$100_F$ | | | | | | $\Delta\Delta G^N$ vs. $\Delta G_{oct}$ 2F5 CDR H3 $100_A$-$100_F$ | | | | | |
|---|---|---|---|---|---|---|---|---|---|---|---|---|
| Strain | Slope | Error (±) | Y-Intercept | Error (±) | $r^2$ | *P* | Slope | Error (±) | Y-Intercept | Error (±) | $r^2$ | *P* |
| MN | 0.95 | 0.18 | 1.1 | 0.6 | 0.81 | 0.0010 | 1.3 | 0.3 | 5.4 | 0.9 | 0.83 | 0.0018 |
| HxB2 | 0.78 | 0.08 | 1.5 | 0.3 | 0.93 | < 0.0001 | 1.1 | 0.1 | 4.6 | 0.3 | 0.97 | < 0.0001 |
| 7312a-C1 | 0.90 | 0.13 | 2.1 | 0.4 | 0.89 | 0.00010 | 1.3 | 0.1 | 5.5 | 0.5 | 0.93 | 0.00010 |
| SC422.8 | 0.82 | 0.13 | 2.9 | 0.5 | 0.88 | 0.00060 | 1.2 | 0.2 | 4.2 | 0.7 | 0.88 | 0.0017 |
| JR-FL | 0.89 | 0.16 | 3.8 | 0.6 | 0.84 | 0.0013 | 1.3 | 0.2 | 5.3 | 0.8 | 0.88 | 0.0018 |
| RHPA-4259 | 0.76 | 0.28 | 3.3 | 1.1 | 0.65 | 0.052 | 1.2 | 0.4 | 5.1 | 1.8 | 0.74 | 0.0610 |
| Overall | | | | | | | 1.2 | 0.1 | 5.1 | 0.3 | 0.86 | <0.0001 |

FIG. 70

TABLE S2. Extra sum-of-squares F-test.

| | $\Delta\Delta G^N$ vs. $\Delta G_{wf}$ | | | $\Delta\Delta G^N$ vs. $\Delta G_{oct}$ | | |
|---|---|---|---|---|---|---|
| Strain | P-Value* | Preferred Model | Sample Size | P-Value* | Preferred Model | Sample Size |
| MN | 0.0243 | quadratic | 8 | 0.1177 | linear | 8 |
| HxB2 | 0.007 | quadratic | 8 | 0.0006 | quadratic | 8 |
| 7312a-C1 | 0.0128 | quadratic | 8 | 0.0005 | quadratic | 8 |
| SC422.8 | 0.0201 | quadratic | 7 | 0.1098 | linear | 7 |
| JR-FL | 0.0088 | quadratic | 7 | 0.047 | quadratic | 7 |
| RHPA-4259 | 0.0864 | linear | 5 | 0.0405 | quadratic | 5 |

*P-values are for validity of quadratic model relative to linear model. In cases where $P<0.05$, the preferred model is chosen as quadratic.

FIG. 71

Table S3. Interpolated maximum effects of hydrophobic transfer, relative to 2F5 wild-type.

| Strain | IC$_{50}$ Minimum* [log (μg/ml)] | ΔG$_{wt}$ of Minimum# (Kcal/mole) | IC$_{50}$ wt 2F5 [log (μg/ml)] | IC$_{50}$ ΔG$_{wt}$=0$^\epsilon$ [log (μg/ml)] | IC$_{50}$ Minimum − IC$_{50}$ wt 2F5$^\&$ [log (μg/ml)] | IC$_{50}$ Minimum − IC$_{50}$ ΔG$_{wt}$=0$^\delta$ [log (μg/ml)] | IC$_{50}$ wt 2F5 − IC$_{50}$ ΔG$_{wt}$=0$^\delta$ [log (μg/ml)] |
|---|---|---|---|---|---|---|---|
| MN | -3.78 | -3.72 | -2.70 | 1.58 | -1.08 | -5.35 | -4.28 |
| HxB2 | -2.48 | -4.32 | -1.70 | 1.53 | -0.79 | -4.01 | -3.23 |
| 7312a-C1 | -2.40 | -3.93 | -1.70 | 2.34 | -0.70 | -4.74 | -4.04 |
| SC422.8 | -1.36 | -3.78 | 0.00 | 4.03 | -1.36 | -5.39 | -4.03 |
| JR-FL | -0.85 | -3.63 | 0.18 | 5.16 | -1.02 | -6.00 | -4.98 |
| RHPA-4259 | -0.70 | -3.75 | 0.15 | 4.55 | -0.84 | -5.25 | -4.41 |
| Mean | -1.93 | -3.86 | -0.96 | 3.20 | -0.96 | -5.12 | -4.16 |

*Minimum IC$_{50}$ values interpolated from quadratic fits of neutralization IC$_{50}$ versus ΔG$_{wt}$ of hydrophobic transfer.
ΔG$_{wt}$ at which minimum IC$_{50}$ occurs.
$^\epsilon$Interpolated IC$_{50}$ values for ΔG$_{wt}$=0, at which no transfer is predicted to occur.
$^\&$Maximum effects relative to wt 2F5 and to 2F5 at which no transfer is predicted to occur (ΔG$_{wt}$=0), shown as log differences.

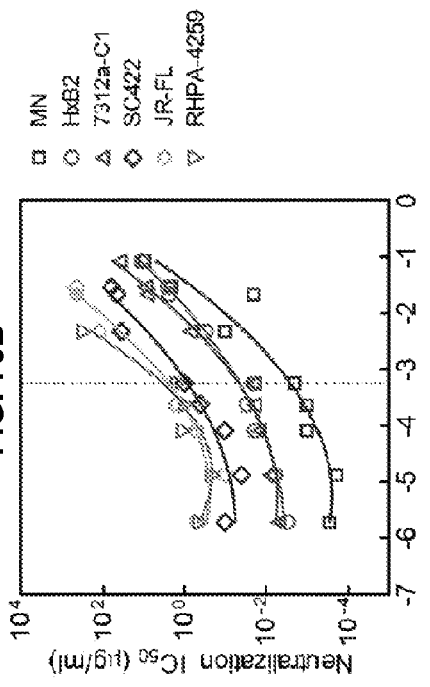
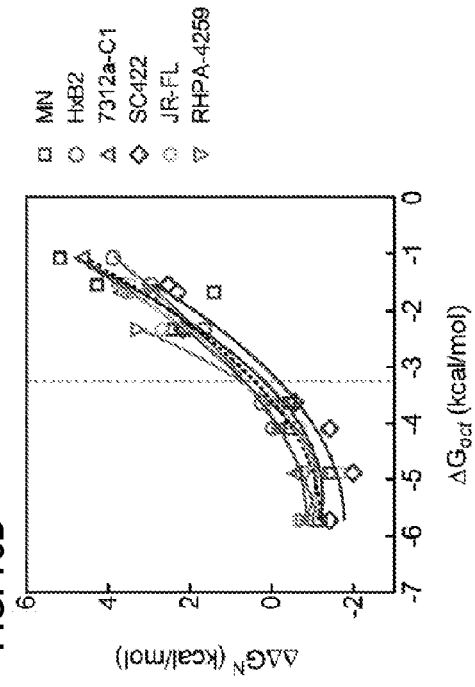
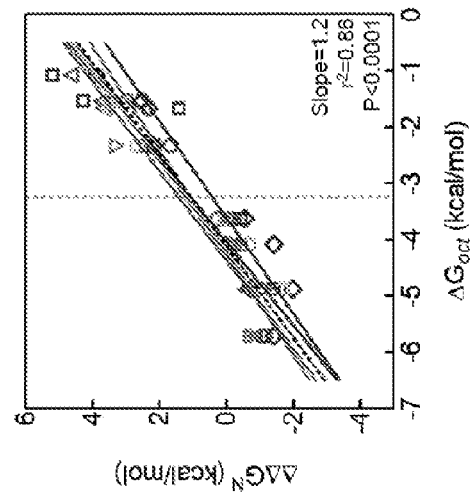
FIG. 73A
FIG. 73B
FIG. 73C
FIG. 73D

FIG. 74A

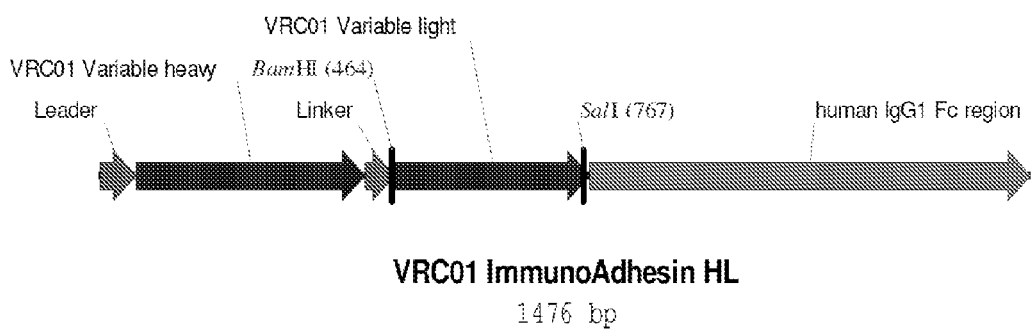

VRC01 ImmunoAdhesin HL
1476 bp atgggatggtcatgtatcatccttttctagtagcaactgcaaccggtgtacattcccaggtgcagctggtgcagtctggaggtcagatgaagaagcct
ggcgagtcgatgagaatttcttgtcgggcttctggatatgaatttattgattgtacgctaaattggattcgtctggcccccggaaaaaaggcctgagtgga
tgggatggctgaagcctcggggggggccgtcaactacgcacgtccacttcagggcagagtgaccatgactcgagacgtttattccgacacagccttt
ttggagctgcgctcgttgacagtagacgacacggccgtctacttttgtactaggggaaaaaactgtgattacaattgggacttcgaacactggggccgg
ggcaccccggtcatcgtctcatcaggagggggaagcggagggggaagcggagggggaagcggagggggatccgaaattgtgttgacacagtctcc
aggcaccctgtctttgtctccaggggaaacagccatcatctcttgtcggaccagtcagtatggttccttagcctggtatcaacagaggcccggccaggc
ccccaggctcgtcatctattcgggctctactcgggccgctggcatcccagacaggttcagcggcagtcggtgggggccagactacaatctcaccatcag
caacctggagtcgggagattttgtgtttattattgccagcagtatgaattttttggccaggggaccaaggtccaggtcgacattaaagagcccaaatc
ttgtgacaaaactcacacatgcccaccgtgcccagcacctgaactcctgggggggaccgtcagtcttcctcttccccccaaaacccaaggacaccctcat
gatctcccggacccctgaggtcacatgcgtggtggtggacgtgagccacgaagaccctgaggtcaagttcaactggtacgtggacggcgtggaggtg
cataatgccaagacaaagccgcggggaggagcagtacaacagcacgtaccgtgtggtcagcgtcctcaccgtcctgcaccaggactggctgaatggc
aaggagtacaagtgcaaggtctccaacaaagccctcccagcccccatcgagaaaaccatctccaaagccaaagggcagccccgagaaccacaggt
gtacaccctgcccccatcccgggatgagctgaccaagaaccaggtcagcctgacctgcctggtcaaaggcttctatcccagcgacatcgccgtggagt
gggagagcaatgggcagccggagaacaactacaagaccacgcctcccgtgctggactccgacggctccttcttcctctacagcaagctcaccgtgga
caagagcaggtggcagcaggggaacgtcttctcatgctccgtgatgcatgaggctctgcacaaccactacacgcagaagagcctctccctgtctccgg
gtaaatga

FIG. 74B

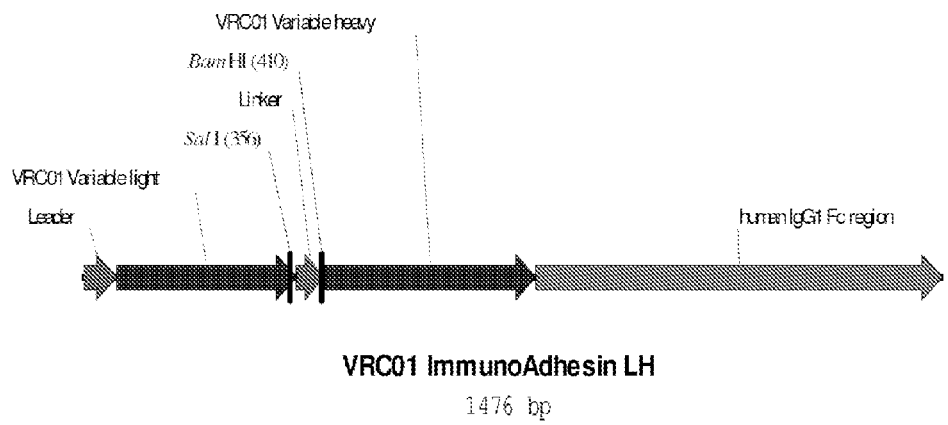

VRC01 ImmunoAdhesin LH
1476 bp atgggatggtcatgtatcatcctttttctagtagcaactgcaaccggtgtacattcagaaattgtgttgacacagtctccaggcaccctgtctttgtctcca
ggggaaacagccatcatctcttgtcggaccagtcagtatggttccttagcctggtatcaacagaggcccggccaggcccccaggctcgtcatctattcg
ggctctactcgggccgctggcatcccagacaggttcagcggcagtcggtgggggccagactacaatctcaccatcagcaacctggagtcgggagattt
tggtgtttattattgccagcagtatgaattttttggccaggggaccaaggtccaggtcgacattaaaggaggggggaagcggagggggaagcggaggg
ggaagcggagggggatcccaggtgcagctggtgcagtctggaggtcagatgaagaagcctggcgagtcgatgagaatttcttgtcgggcttctggat
atgaatttattgattgtacgctaaattggattcgtctggcccccggaaaaaggcctgagtggatgggatggctgaagcctcggggggggccgtcaac
tacgcacgtccacttcagggcagagtgaccatgactcgagacgtttattccgacacagccttttggagctgcgctcgttgacagtagacgacacggcc
gtctactttgtactaggggaaaaaactgtgattacaattgggacttcgaacactggggccggggcacccggtcatcgtctcatcagagcccaaatct
tgtgacaaaactcacacatgcccaccgtgcccagcacctgaactcctgggggaccgtcagtcttcctcttccccccaaaacccaaggacacctcat
gatctcccggacccctgaggtcacatgcgtggtggtggacgtgagccacgaagaccctgaggtcaagttcaactggtacgtggacggcgtggaggtg
cataatgccaagacaaagccgcggaggagcagtacaacagcacgtaccgtgtggtcagcgtcctcaccgtcctgcaccaggactggctgaatggc
aaggagtacaagtgcaaggtctccaacaaagccctcccagcccccatcgagaaaaccatctccaaagccaaagggcagccccgagaaccacaggt
gtacaccctgcccccatcccgggatgagctgaccaagaaccaggtcagcctgacctgcctggtcaaaggcttctatcccagcgacatcgccgtggagt
gggagagcaatgggcagccggagaacaactacaagaccacgcctcccgtgctggactccgacggctccttcttcctctacagcaagctcaccgtgga
caagagcaggtggcagcaggggaacgtcttctcatgctccgtgatgcatgaggctctgcacaaccactacacgcagaagagcctctccctgtctccgg
gtaaatga

FIG. 75A
1. VRC8551:
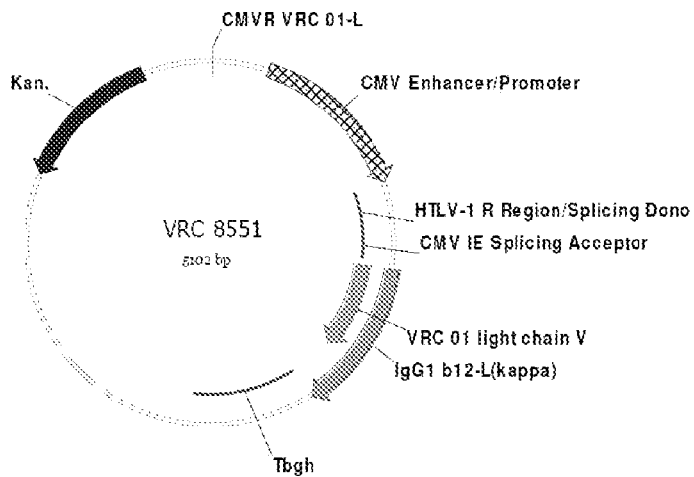
2. VRC8552:
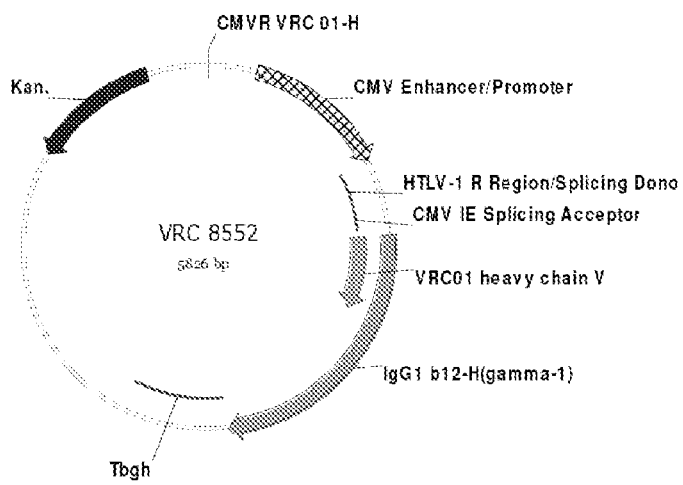
3. VRC9709:
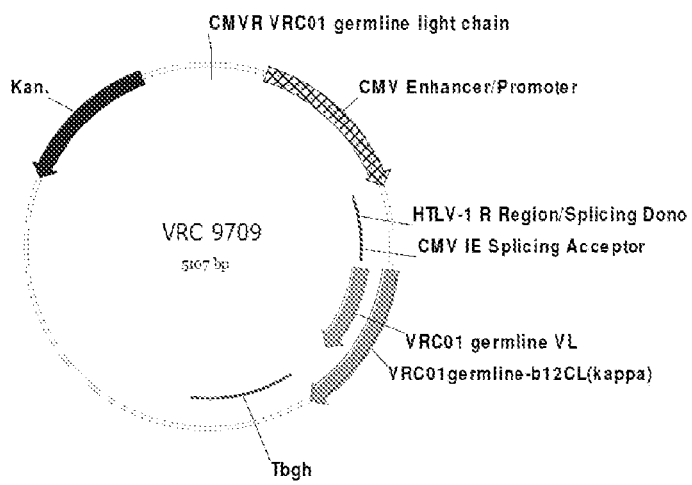

FIG. 75B
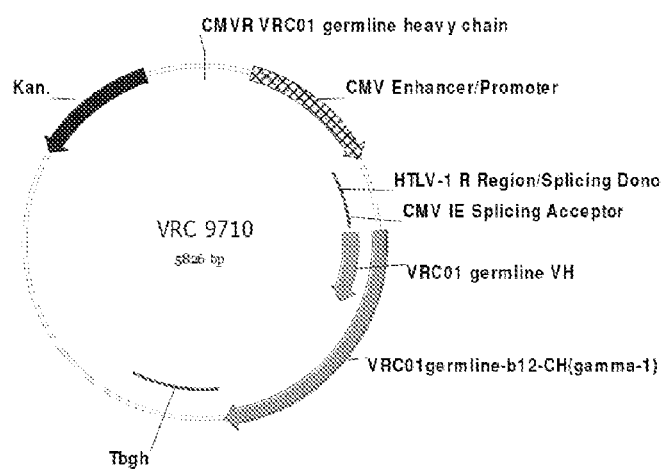
4. VRC9710:
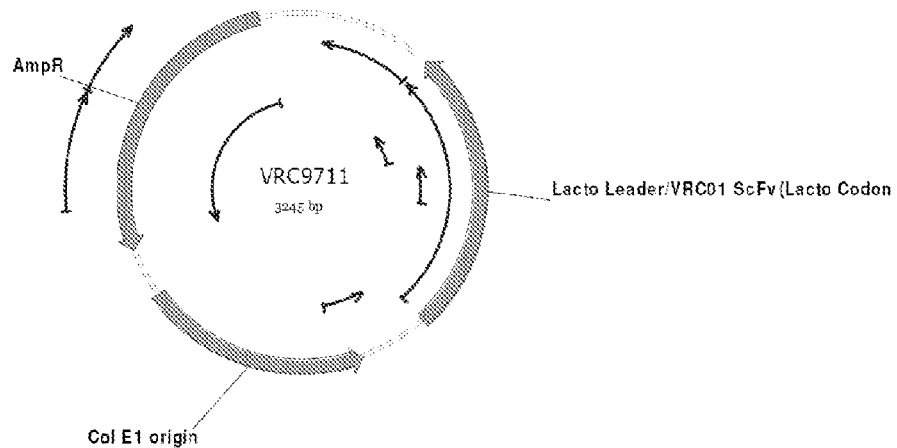
5. VRC9711:

6. VRC9712:  FIG. 75C
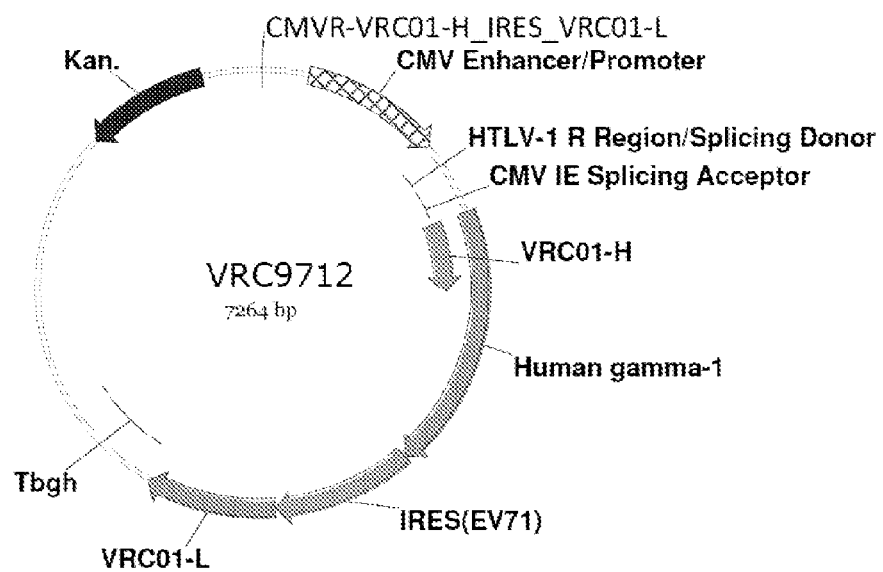
7. VRC9713:
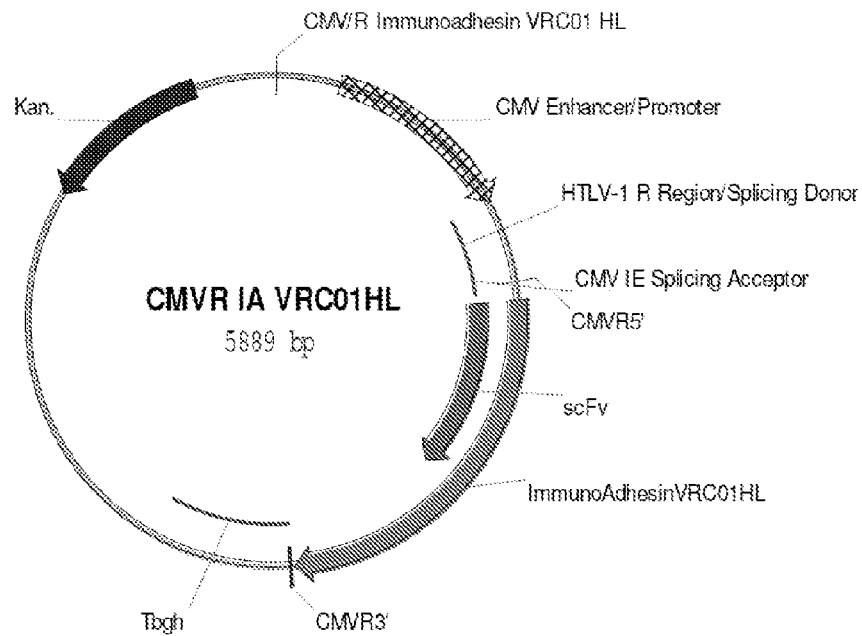

FIG. 75D
8. VRC9714:
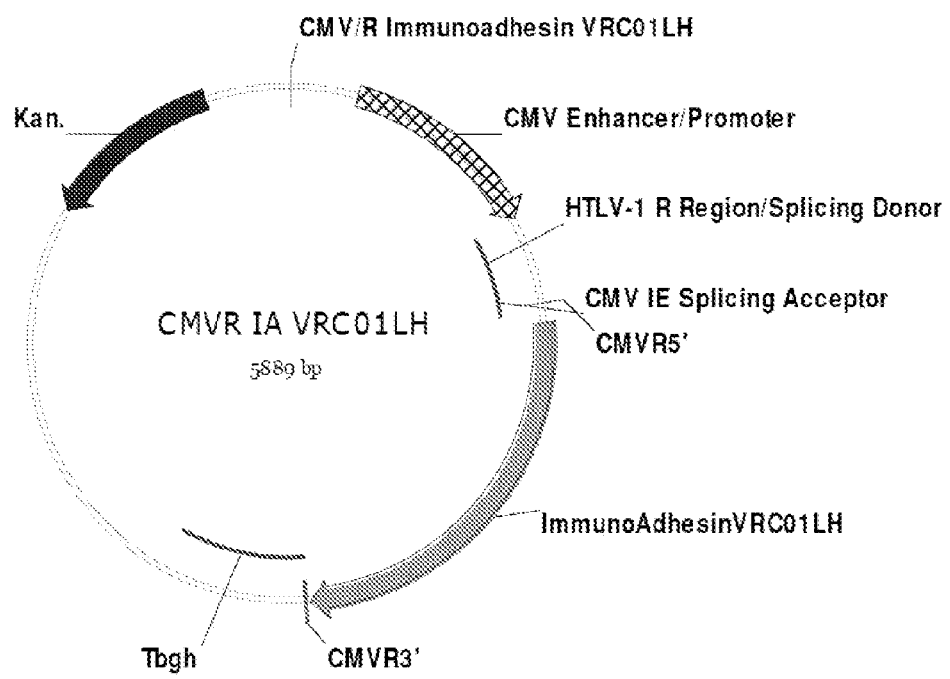
9. VRC9715:
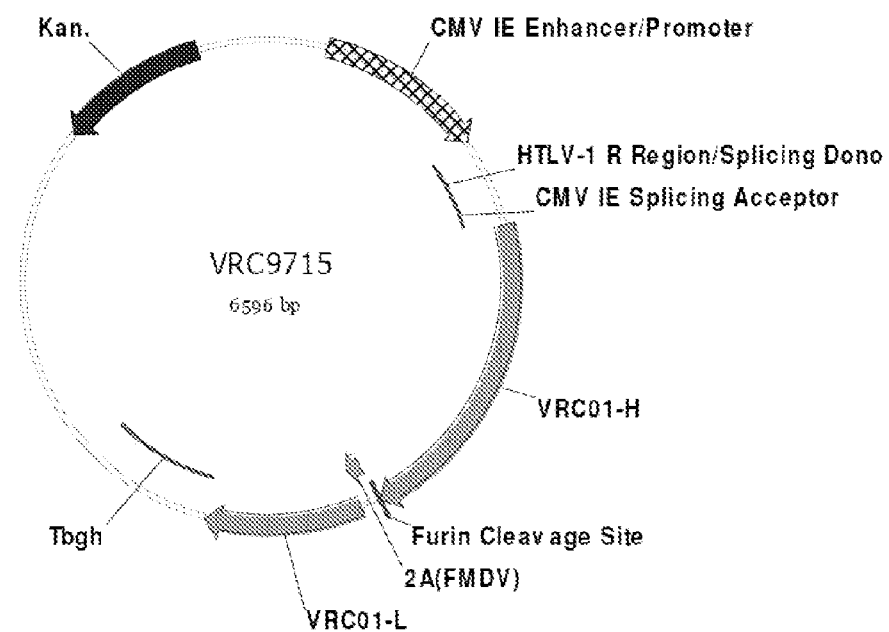

FIG. 75E
10. VRC9716:
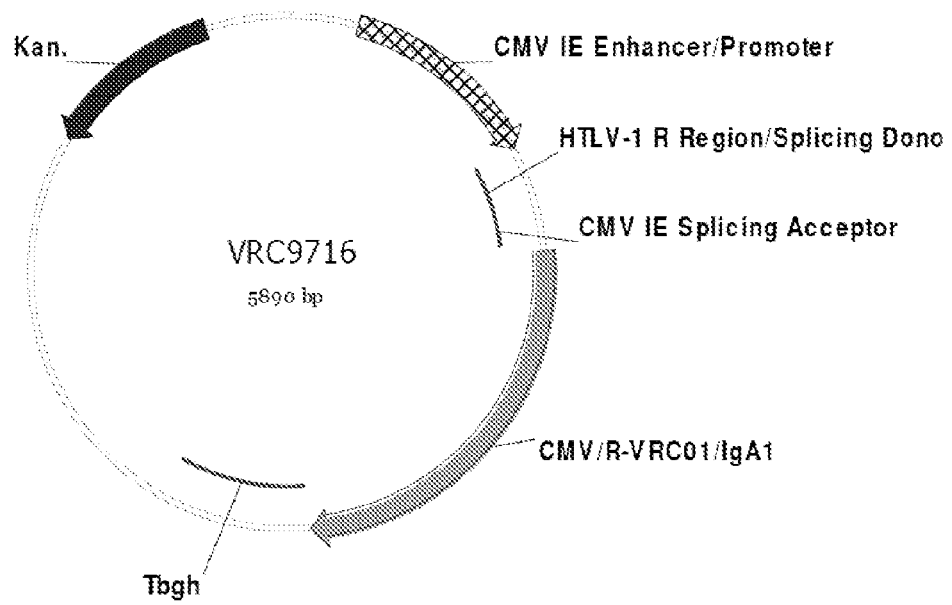
11. VRC9717:
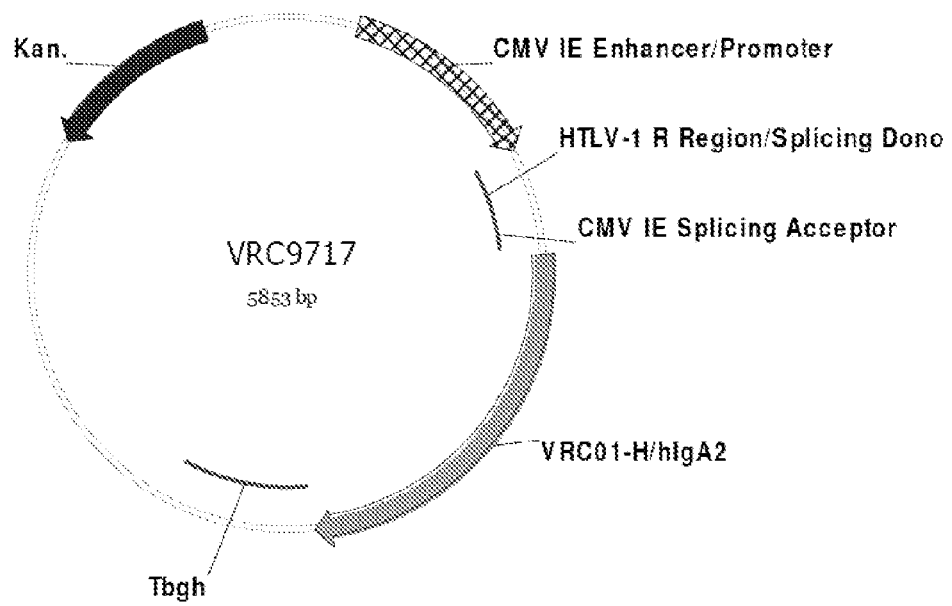

FIG. 76

Expression of VRC01/03 heavy and light chain chimeras

Summary of VRC01/03 Chimeras

| Chimera # | 1 | 3 |
|---|---|---|
| Chimera type | Heavy VRC01/ Light VRC03 | Heavy VRC03/ Light VRC01 |
| Conc. (mg/ml) | 4.7 | 3.0 |
| Prot. A column | New | New |
| Vol. of product (m)l | 10 | 14.2 |
| SDS-PAGE analysis | Good | Good |
| yield | 47mg/0.6L | 43mg/0.6L |

SDS-PAGE, 4-12%, reducing
Loaded: 1-2 ug of chimera/lane

M 1 3

Heavy Chain

Light Chain

Clade A viruses

Clade B viruses

Clade C viruses

FIG. 80

Alignment of 57203 to VRC01 and Germline 02*02

Heavy-chain

```
            --------FR1-----------         --------CDR1-----------         --------FR2-----------         --------CDR2--------             --------FR3-----------                                   IGHD3-16*02         JH1*01
                                                                                                                                                                                                   -----CDR3-----      -----FR4-----
IGHV1-02*02 QVQLVQSGAEVKKPGASVKVSCKASGYTF.TGYYMHWVRQAPGQGLEWMGWINPNSGGTNY.AQKFQGRVTMTRD........TSISTAYMELSRLRSDDTAVYYCAR          DYYW           AEYFQHWGQGTLVTVSS
VRC01       QVQLVQSGG..KKPG.S.IS..ASGY.F.1..T..W..R.APG...EWMGW..RP..G.VNY.A..L.QGRVTMTRD........V.......TA..EL.SL..DDTAVY.C.RGKN..DYEW                              DF.HWG.GT..V.VSS
VRC02       QVQLVQSGG..KKPG.S.IS..ASGY.F.1..T..W..R.APG...EWMGW..RP..G.VNY.A..L.QGRVTMTRD........V.......TA..EL.SL.TADDTAVYYC.RGKN..DY.W                             DF.HWG.GT..VTVSS
VRC03       QVQLVQSGA..K.PG.SVK.SC.ASGY.F..D.Y..HWR..P.G..W.GW.KP..WG.V.Y.A....QGRV.MTR.........D.M..AYMEP.GL..ADTA.Y.C.RRGS.DYC.DFPWQ                             XWGQGT.VVVSS
57203       QVQLVQSGTEVKVKPGASVV.C.CKASGY.F ..YY..WV.WVRQAPGQGLEWMGWINPX..G.TNY A.KFQGRV.MTRD            T.I.TAY.EL..EL.SDDTAVYYC.RGARGMPKGAF                          DIWGQGTLVIVSS
```

Clade A

Clade C  Du156.12

ZM109.4

Negative Controls

MuLV

SIVmac251.30.SIV

100830_CVL1608_001

FIG. 83
Gene Family Analysis

Repertoire and mutation analysis of VRC mAbs

Heavy Chain

| | IGHV | IGHD | IGHJ | CDR3 length (amino acids) | VH mutation frequency (nucleotides) |
|---|---|---|---|---|---|
| VRC01 | 1-02*02 | 3-16*01 (or *02) | 1*01 | 14 | 91/288 (32%) |
| VRC02 | 1-02*02 | 3-16*01 (or *02) | 1*01 | 14 | 92/288 (32%) |
| VRC03 | 1-02*02 | IGHD3 family | 1*01 | 16 | 85/288 (30%) |

Light Chain

| | IGKV | IGKJ | CDR3 length (amino acids) | VL mutation frequency (nucleotides) |
|---|---|---|---|---|
| VRC01 | 3-11*01 | 2*01 | 5 | 45/264 (17%) |
| VRC02 | 3-11*01 | 2*01 | 5 | 49/264 (19%) |
| VRC03 | 3-11*01 | 2*01 | 5 | 53/267 (20%) |

FIG. 84

Different Antibodies Recognize Similar Epitopes

VRC01

VRC03

Antibody interactions with conformationally mobile regions on gp120 vary

Epitopes Overlap with Site of Vulnerability

VRC01

VRC03

The Shared Site Overlaps with the Site of Vulnerability

FIG. 88

The Shared Site is the Major Antibody Contact

| Complex | On shared site ($Å^2$) | Total on gp120 ($Å^2$

Figure 89:
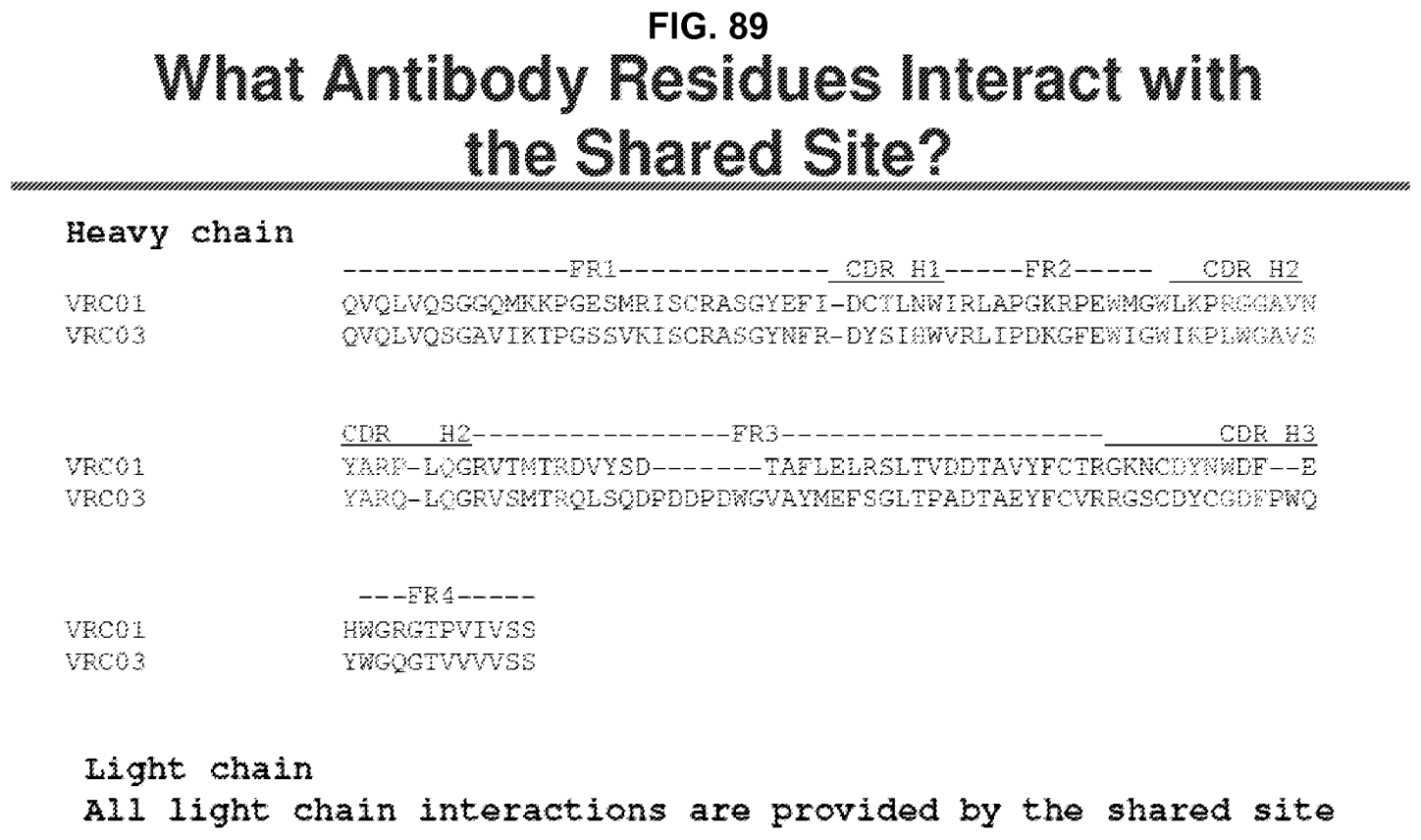

FIG. 89
What Antibody Residues Interact with the Shared Site?

```
                 50        60        70        80        90
                  |         |         |         |         |
93Th057    VWKDADTTLFCASDAKAHETEVHNVWATHACVPTDPNPQETHLENVTENF
HXBc2      VWKEATTTLFCASDAKAYDTEVHNVWATHACVPTDPNPQEVVLVNVTENF 100       110       120  ****  194* *200
                           |         |         |        °°      *
                                                                °
93Th057    NMWKNNMVEQMQEDVISLWDQSLQPCVKLT-----GG-----SVIKQACPK
HXBc2      NMWKNDMVEQMHEDIISLWDQSLKPCVKLTPLCVGAGSCNTSVITQACPK 210       220       230       240       250
                  |         |         |         |         |
                                                                    *
93Th057    ISFDPIPIHYCTPAGYVILKCNDKNFNGTGPCKNVSSVQCTHGIKPVVST
HXBc2      VSFEPIPIHYCAPAGFAILKCNNKTFNGTGPCTNVSTVQCTHGIRPVVST 260       270     *****   290       300
                  |         |     *   ****
                                  * *****
93Th057    QLLINGSLAEEEIIIRSENLTNNAKTIIVHLNKSVEINCTRPSNGGSGSG
HXBc2      QLLINGSLAEEEVVIRSVNFTDNAKTIIVQLNTSVEINCF-----GAG--

330       340       350       360     ********
                  |         |         |         |      ****  *
                                                              *
93Th057    GDIRKAYCEINGTKWNKVLKQVTEKLKEHF-NNKTIIFQPPSGGDLEITM
HXBc2      ------HCNISRAKWNNTLKQIASKLREQFGNNKTIIFKQSSGGDPEIVT

*     380       390       400       410       420
              *      |         |         |         |         |
              *
93Th057    HHFNCRGEFFYCNITQLFNNTCIG-NETMKGCN------GTITLPCKIQI
HXBc2      HSFNCGGEFFYCNSTQLFNSTWFNSTWSTEGSNNTEGSDTITLPCRIKQI

** ** **** *   440       450    * ****** *   * ***
              *** *                        **** **** * *  **
            *** **                          *** *** **** * **
93Th057    INMWQGTGQAMYAPPIDGKINCVSNITGILLTRDGGAKNTSNETFRPGGG
HXBc2      INMWQKVGKAMYAPPISGQIRCSSNITGLLLTRDGGNSNNESEIFRPGGG

****  480       490
            *    |         |
            **
93Th057    NIKDNWRSELYKYKVVQIE
HXBc2      DMRDNWRSELYKYKVVKIE
```

Symbols:
¤ Side chain only
° main chain only
● both side and main chain

Color code:
* CD4 contact
* VRC01 contact
* VRC03 contact

Site of vulnerability       N₂₇₆NAKT₂₈₃..S₃₆₅GGDLE₃₇₀..R₃₇₄..T₄₅₅RDGGAN₄₆₁....R₄₆₉..G₄₇₁GGN₄₇₄
Common site of VRC0s        N₂₇₆..T₂₈₂NNAKT₂₈₅....S₃₆₅GGD₃₆₈..I₃₇₁...T₄₅₅RDGG₄₅₉.N₄₆₁..P₄₆₉..G₄₇₁GGN₄₇₃

Schematic of the construction of IgM plasmids
The VH fragment of the VRCO-1 IgG Heavy chain was cloned instead of the Vμ fragment of the germ-line IgM μ Cain, by XbaI-MfeI cut. Production of IgM wit or without Human J-chain was carried in 293F cells via transient transfection with the appropriate plasmids.

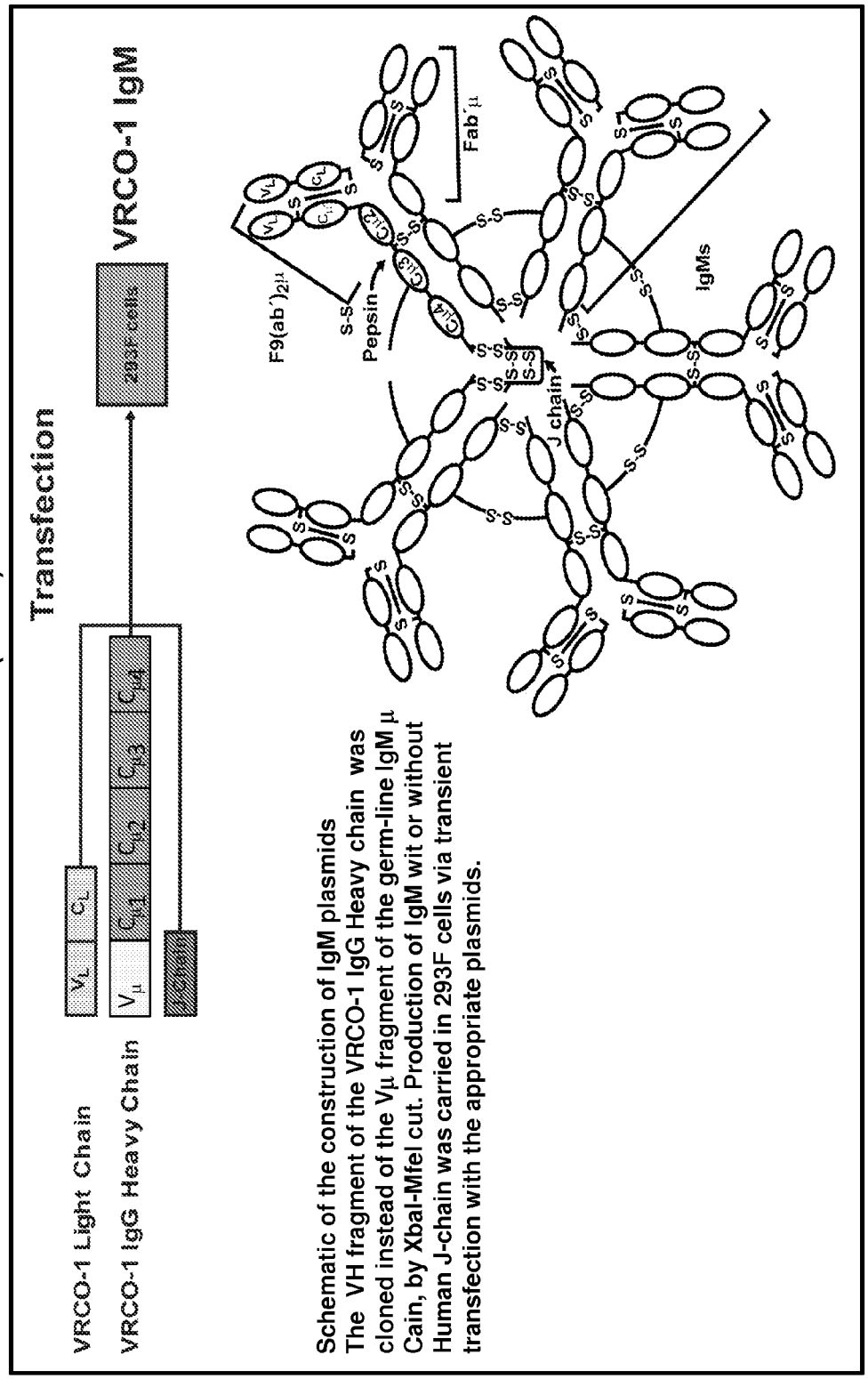
FIG. 92A (Con't)

FIG. 92B

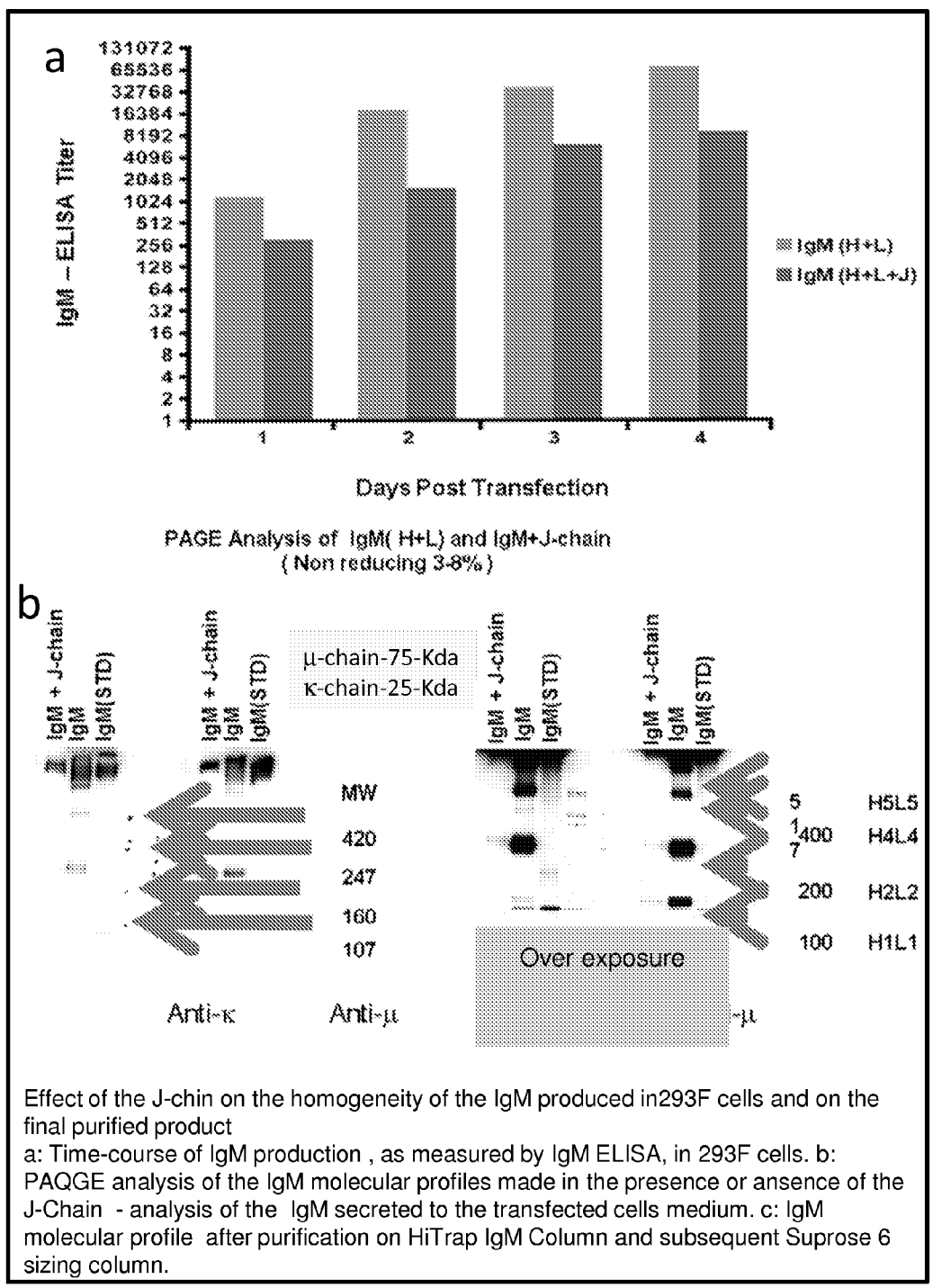

Effect of the J-chin on the homogeneity of the IgM produced in293F cells and on the final purified product
a: Time-course of IgM production , as measured by IgM ELISA, in 293F cells. b: PAQGE analysis of the IgM molecular profiles made in the presence or ansence of the J-Chain - analysis of the IgM secreted to the transfected cells medium. c: IgM molecular profile after purification on HiTrap IgM Column and subsequent Suprose 6 sizing column.

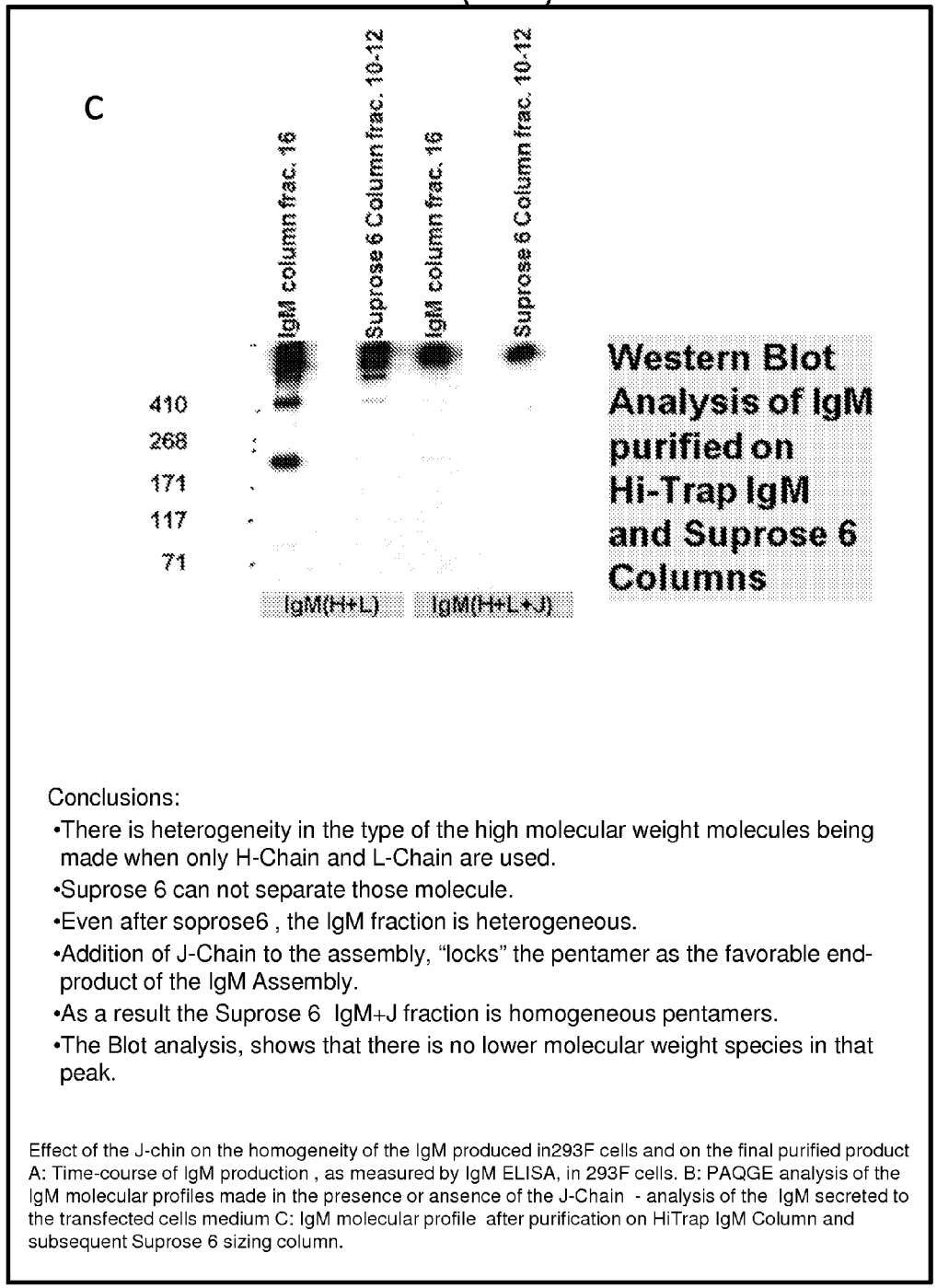

FIG. 92B (Con't)

Conclusions:
- There is heterogeneity in the type of the high molecular weight molecules being made when only H-Chain and L-Chain are used.
- Suprose 6 can not separate those molecule.
- Even after soprose6 , the IgM fraction is heterogeneous.
- Addition of J-Chain to the assembly, "locks" the pentamer as the favorable end-product of the IgM Assembly.
- As a result the Suprose 6 IgM+J fraction is homogeneous pentamers.
- The Blot analysis, shows that there is no lower molecular weight species in that peak.

Effect of the J-chin on the homogeneity of the IgM produced in293F cells and on the final purified product A: Time-course of IgM production , as measured by IgM ELISA, in 293F cells. B: PAQGE analysis of the IgM molecular profiles made in the presence or ansence of the J-Chain  - analysis of the IgM secreted to the transfected cells medium C: IgM molecular profile  after purification on HiTrap IgM Column and subsequent Suprose 6 sizing column.

Large scale purification of IgM from 293F cells transfected with 3 plasmids expressing the Heavy and Light chains of VRCO-1 IgM + Human J-chain.

FIG. 92D

| IC50 (nM) | Clade B | | | | Clade A | | Clade C | | | |
|---|---|---|---|---|---|---|---|---|---|---|
| Sample | JRFL.JB | TRO.11 | AC10.29 | 7165.18 | DJ263.8 | RW020.2 | DU156.12 | ZA012.29 | DU151.01 | DU123.6 |
| VRC01 IgM | 0.04 | 1.1 | 5.4 | >83 | 0.06 | 0.32 | 0.68 | 0.98 | 0.75 | 3.7 |
| VRC01 IgG | 0.11 | 1.8 | 9.7 | >100 | 0.30 | 0.94 | 0.81 | 1.5 | 2.8 | >100 |

| IC80 (nM) | Clade B | | | | Clade A | | Clade C | | | |
|---|---|---|---|---|---|---|---|---|---|---|
| Sample | JRFL.JB | TRO.11 | AC10.29 | 7165.18 | DJ263.8 | RW020.2 | DU156.12 | ZA012.29 | DU151.01 | DU123.6 |
| VRC01 IgM | 0.27 | 4.9 | 33 | >83 | 1.3 | 5.3 | 1.2 | 1.4 | 1.7 | 24 |
| VRC01 IgG | 0.74 | 8.2 | 61 | >100 | 15 | 7.8 | 1.6 | 3.1 | 11 | >100 |

| IC90 (nM) | Clade B | | | | Clade A | | Clade C | | | |
|---|---|---|---|---|---|---|---|---|---|---|
| Sample | JRFL.JB | TRO.11 | AC10.29 | 7165.18 | DJ263.8 | RW020.2 | DU156.12 | ZA012.29 | DU151.01 | DU123.6 |
| VRC01 IgM | 0.74 | 11 | 61 | >83 | 10 | 11 | 1.8 | 1.8 | 3.0 | 70 |
| VRC01 IgG | 1.8 | 19 | 94 | >100 | >100 | 14 | 2.5 | 5.3 | 65 | >100 |

Comparative neutralization abilities of VRCO-1 IgG and VRCO-1 IgM toward selected HIV-1 viruses of clade A,B and C.

Targeting Correlates with Neutralization

FIG. 94
Structural of VRC03/VRC01 gp120 Complexes
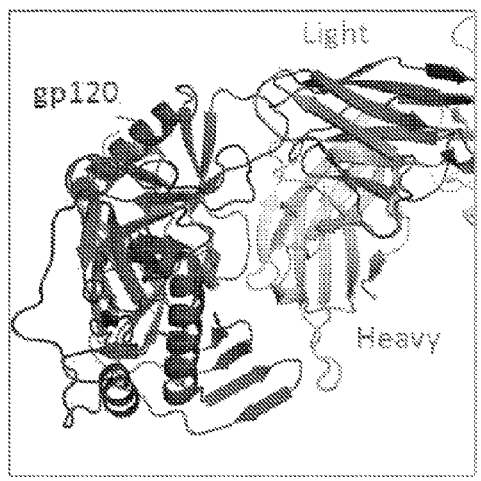
VRC03
1.9 A
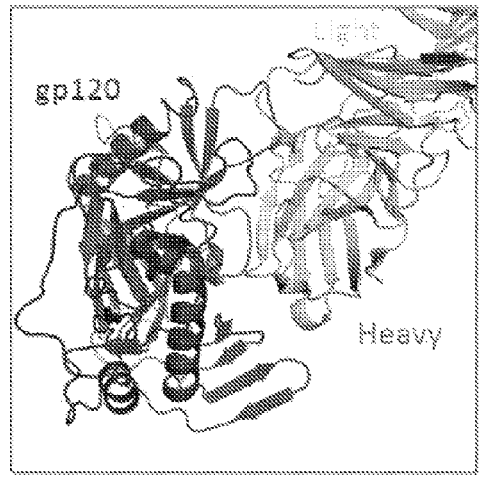
VRC01
2.9 A

Mimicry of CD4 Receptor by Antibody VRC01

CD4 and VRC01 in highly similar positions

Heavy Chains Have Similar Orientation

FIG. 97
Key Interactions Conserved
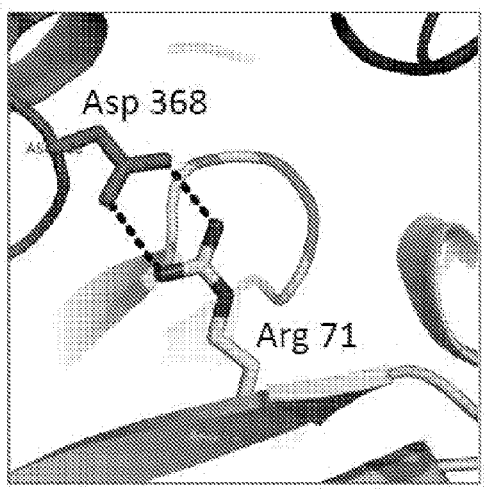
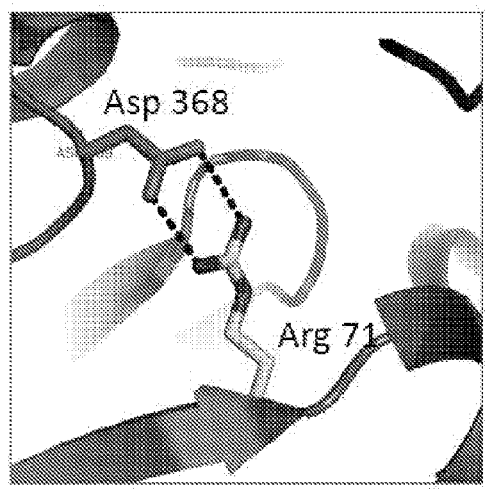

FIG. 98

Bioinformatics analysis strategy

- Stage-1: Primary analysis

To characterize and understand the 454 sequencing data set in a systematic and statistical manner and to generate data required for the production analysis.

- Stage-2: Production analysis

To identify VRC01-, VRC02- and VRC03-like broadly neutralizing anti-HIV-1 antibodies from the 454 sequencing data based on the results calculated in the primary analysis.

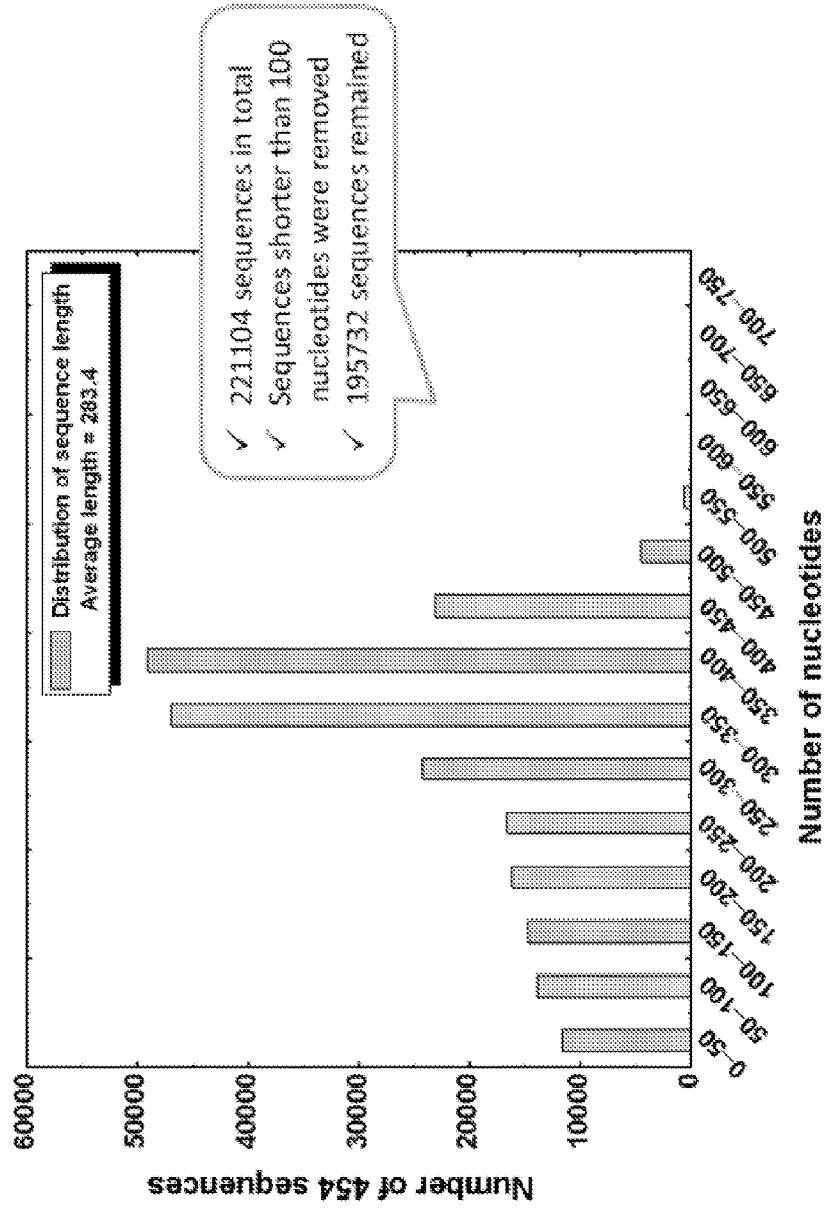

FIG. 101
Step 2.2 characterize sequence variation (2*02)

- Alignment coverage
  — 454 sequences may differ significantly in length and correspond to different regions of antibody sequence(s).
  — Sequence variation can affect alignment quality and cause noise in the calculation of sequence identity
  — Alignment coverage can be used to quantify the effect of sequence variation on alignment.

$$Coverage_{IGHV\ 1-2*02} = \frac{Length\ (aligned\ region)}{Length\ (IGHV\ 1-2*02)} \quad Coverage_{454-sequence} = \frac{Length\ (aligned\ region)}{Length\ (454-sequence)}$$

— ClustalW2: sequence identity and divergence can be also calculated from the global alignment generated by ClustalW2.

- Conclusion:
  — For half of the sequences (11563), alignment can only partially cover the 454 sequence and IGHV1-2*02 due to the sequence variation
  — The distribution of 02*02 divergence can be calculated for the whole population or the just the upper-right corner population, using either 02*02 or query itself as a reference. The two distributions are fitted into Gaussian and then evaluated.

Step 2.3 characterize IGHV1-2*02 divergence

FIG. 104

Step 3.1 compare to VRC antibodies (DNA)

- Alignment coverage
  - 454 sequences may differ significantly in length and correspond to different regions of antibody sequence(s).
  - Sequence variation can affect alignment quality and cause noise in the calculation of sequence identity
  - Alignment coverage can be used to quantify the effect of sequence variation on alignment.

$$Coverage_{VRC\ 0\text{-}seq} = \frac{Length\ (aligned\ region)}{Length\ (VRC\ 0X_{v1,2,3})} \quad Coverage_{454\text{-}sequence} = \frac{Length\ (aligned\ region)}{Length\ (454\text{-}sequence)}$$

- ClustalW2: sequence identity and divergence can be also calculated from the global alignment generated by ClustalW2.

- Conclusion:
  - Less than 1/4 of the sequences can generate alignment that covers >50% of both VRC0X and 454 sequence (See upper-right corner population).
  - The distribution of sequence identity can be calculated for the whole population or the just the upper-right corner population, using either VRC0X or query itself as a reference. The two distributions are fitted into Gaussian and then evaluated.

FIG. 105

Step 3.1 plot sequence variation and comparison

- Contour analysis of alignment coverage

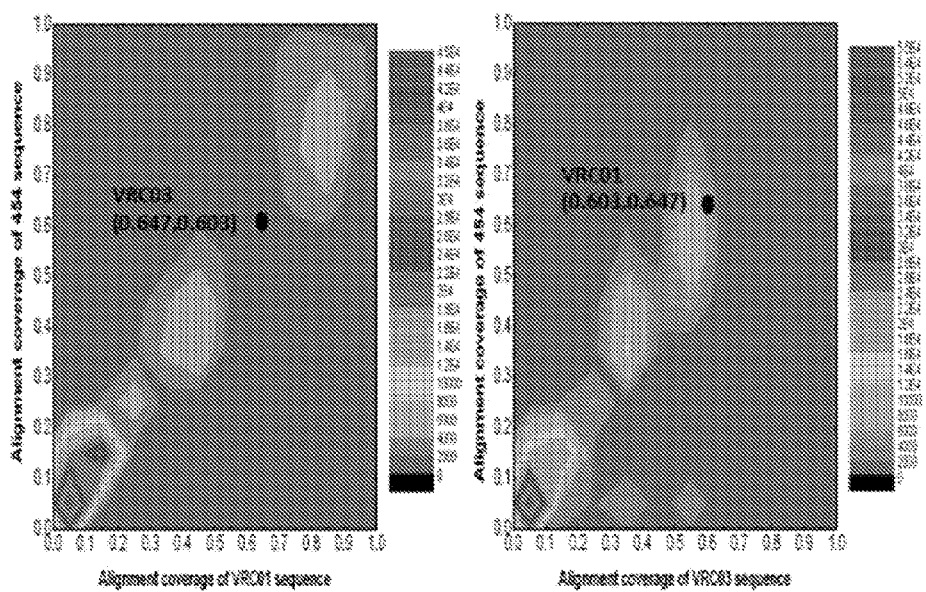

- Majority of the 454 sequences are partial sequences that cannot cover 50% of the alignment.
- However, there is still a large population of sequences centered at (0.85, 0.80) that can be aligned to VRC01 with a good coverage, which may contain VRC01-like neutralizing antibodies.
- VRC03 alignment generated by blastn is problematic due to the 7-residue insertion. They will be analyzed separately.

FIG. 107

Step 4: correct sequencing errors

- Sequencing errors in 454 data set:

— Deletions and insertions:
     (1) Cause frame shift. Because the amino acid sequence after the position where such error occurs becomes nonsensical, deletions and insertions have a global effect on the quality of protein sequence.
     (2) Can be detected through alignment with a "reference" sequence.
  — Substitutions:
     (1) Can cause a "mutation" in the translated amino acid sequence.
  Substations
     only have a local effect on the quality of protein sequence.
     (2) Hard to detect since we cannot distinguish substitution errors from naturally occurred mutations during the antibody maturation process.

- Procedure for correcting sequencing errors:

1. For a given 454 sequence, choose its germline gene sequence as a reference
  2. Align the 454 sequence onto the germline gene sequence using blastn
  3. Detect the gap sign "-" in the alignment: if a gap is found in the 454 sequence, it is considered a deletion error and the corresponding nucleotide in the germline will be "borrowed" to fill the gap; if a gap is in the germline, it is considered an insertion error and will be removed
  4. A new nucleotide sequence is reconstructed and translated to protein sequence Step 4.2 assess correction results

FIG. 111
Steps 6 & 7 pull out full sequences for threading

- Imposing "QVQ" and "WGXG" motifs to select full-length antibody VH sequences
  - 3-residue variation is allowed at both ends (N- and C-termini) of the sequence
  - 25,496 "full-length" sequences were extracted from the data set, accounting for 13% of the data set

- Evaluating whether the selected 454 sequences can adopt a similar binding mode to that of the VRC01 or VRC03 with threading
  - Threading is a protein modeling technique used to model those proteins which have the same structural fold as the template protein but do not have obvious sequence homology
  - Computational procedure:
    Step 1: Sequence alignment with ClustalW2
    Step 2: Model building with Nest and construction of a model complex with VL and gp120
    Step 3: Calculation of threading score with normalized DFIRE function
  - Benchmarking by threading VRC01, 03 sequences onto themselves and each other. A cut off of 0.150 seems to be reasonable to select good threaders.

|  | Seq_VRC01 | Seq_VRC03 |
|---|---|---|
| Struct_VRC01 | 0.033 | 0.310 |
| Struct_VRC03 | 0.122 | 0.031 |

High score due to ab initio modeling of the insertion

FIG. 112

Stage-2: Production analysis

- Multiple steps and multiple analyses:

— Round 1. Identify and synthesize 10 VRC0X-like sequences based on protein sequence identity (data obtained from Step 3). #57203 was confirmed to be a neutralizer — Round 2. Identify and synthesize 10 VRC0X-like sequences based on threading and clustering analysis (data obtained from Step 6)

— Round 3. Identify and synthesize 10 VRC0X-like sequences based on 2*02 sequence divergence (data from Step 2 and 5)

— Round 4. Identify and synthesize 10 VRC0X-like sequences based on 2*02 divergence and threading (data from Step 2 and 6)

FIG. 113

Round 1: sequence identity

- VRC01-like sequences identified by DNA sequence identity (top 5):

>index=84057 germ=IGHV1-2*02 SeqID_VRC01=315/363
GTGCAGCTGGTGCAGTCTGGGACTGAGGTGAAGAAGCCTGGGGCCTCGGTGAGGGTCTCCTGCAAGGCTTCTGGATACACGTTCACCGAC
TACTTTGTACACTGGGTGCGACAGGCCCCTGGACAAGGTCTTGAGTGGATGGGATGTATCAATCCTCAGAGTGATGACACAAAGTATGCA
CAGAAATTTCAGGGGAGGGTCACCATGACCAGGGACACGTCCACCAATACAGCCTACATGGAACTGAGTGGACTGACATTTGACGACACG
GCCATGTATTATTGCCTACTGCAATAGATGGGATCGTCTACTGGGGCCAGGGACCCCTGGTCACCGTTTCCCCAGCCTCCACCAAGGGCC
CATCGGTCTTCCCCCTGGCACCCTCCTCCAAGAGCACCTCTGGGGGCACAGCAGCCCCTGGGCTGCCTGGTCAAGGACTACTTCCCCGAACC
GGTGACGGTGTCGTGGAACTCAGGCGC
CCTGACCAGCGGCGTGCACACCTTCC
>index=18400 germ=IGHV1-2*02 SeqID_VRC01=304/363
TCTGGGCGTGAGGTGAAGAAGCCTGGGCCGTCAGTGAAGGTCTCCTGCAAGGCTTCTGGATACACCTTCACCGGCTACTTTATGCACTGGG
TGCGACAGGCCCCTGGACAAGGGCTGGAGTGGATGGGATGGATCAACCCTAACAGTGAAAACACAAACTATGCACAGAAGTTTCAGGGA
AGGATCACCATGACCAGGGACACGGCCGTCAGCACGGCCTATTTGGAGCTGAACACCCTGAGATCTGACGACACGGCCGTCTACTACTGT
GCGAGACTACAAAGCCTTCATGGACTGTATTCTAACGCTGACTATTGGGGCCAGGGAACGCTGGTCACCGTCTCCTCAGCCTCCACCAAGG
GCCCATGGTCTTCCCCCCTGGCACCCTCCTCCAAGAGCACCTCTGGGGGCACAGCAGCCCTGGGCTGCCTGGTCAAGGACTACTTCCCCG
AACCGGTGACGGTGTCGTGGAACTCAGGCGCCCTGACCAGCGGCGTGCACACCTTCC
>index=20306 germ=IGHV1-2*02 SeqID_VRC01=303/363
GTGCAGCTGGTGCAGTCTGGGGCGTGAGGTGAAGAAGCCTGGGGCCTCAATGAGGGTCTCATGTCAGACTTCAGGATACACGTTTAACTCC
TATTATATACACTGGATGCGCCAGGTCCCTGGACAAGGCCTTGAGTGGATGGGATGGATTAACCCTAATAGTGGTTACACAAACTATACAC
AGAAATTTCAGGGGAAGGGTCACCATGACCAGGGATACGTCCATTAACACGCTACCTGGAGCTCACCTGGAGATCTGACGACACGGCCGTT
CCGTTTATTATTGTGCGAGAGACTTTAGCGACGCGTTGGCCTTACTCCTTCGACTTCTGGGGCCAGGGAACTCTAGTCACCGTCTCCTCAGCC
TCCACCAAGGGCCCCATCGGTCTTCCCCCTGGCACCCTCCTCCAAGAGCACCTCTGGGGGCACAGCGGCCCTTGGGCTGCCTGGTCAAGGAC
TACTTCCCCGAACCGGTGACGGTGTCGTGGAACTCAGGCGCCCTGACCAGCGGCGTGCACACCTTCC
>index=25577 germ=IGHV1-2*02 SeqID_VRC01=303/363
GTGCAGCTGGTGCAGTCTGGGGCCGGAGGTGAAGAAGCCTGGGGCCTCAGTGAAGGTCTCCTGCCAGGCTTCTGGATACACCTTCACCGAC
TACTATATACACTGGGTGCGACAGGCCCCTGGAAGAAGGGCCTGAATGGATGGGATGGATCAACCCTAATAATGGTGTCACAAACTATGCA
CAGAAGTTTCAGGGCAGGGTCACCCTGACCAGAGACACGTCCATCGGCACAGCCTACATGGAACTAAGCGGGCTGACATCTGACGACACG
GCCATTTATTACTGCATGCCTGGGCCTCACTGGGCCAGGGAACCCTGGTCACCGTCTCCTCAGCCTCCACCAAGGGCCCGTCGGTCTTCCC
CCTGGCGCCCTGCTCCAGGAGCCACCTCCAGAGAGCACAGCGGCCCTGGCCTGCCTGGTCAAGGACTACTCCCGAACCGGTGACGGTGTCG
TGGAACTCAGGACGCTCTGACCAGCGGCGTGCACACCTTCCA
>index=29039 germ=IGHV1-2*02 SeqID_VRC01=303/363
GCAACCGTGTACATTCCCAGGTGCAGCTGGTGCAGTCTGGGGCTGAGGTGAAGAAGCCTGGGGCCTCAGTGAAGGTCTCCTGCAAGGC
TTCTGGATACACCTTCACCGACTACTATATACACTGGGTGCGACAGGACCTGGGTGCACAAGGACTTGAGTGGATGGGATGCATCAACCCTAAC
AGTGGTGGCACAAACTCTGCACAAAAGTTTCAGGGCAGGGTCACCATGACCAGGGACACGTCCATCACCACAGCCTACATGGAGCTGAGT
AGGCTGAGATCTGACGACACGGCCATGTATTATTGTGCGAGGGGAATTACGGAGACTACTGGGGCCAGGGAACGCTGGTCACCGTCTCGT
CAGCCTCCACCAAGGGCCCATCGGTCTTCCCCCTGGCGCCCTGCTCCAGGACGCACCTCCGAGACGCACAGCGGCCCTGGGCTGCCTGGTC
AAGGCTACTCCCGAACGGTGACGGTGTCGTGGAACTC

FIG. 114

Round 1: sequence identity

- VRC01-like sequences identified by protein sequence identity (top 5 and more):

>index=2015 germ=IGHV1-18*01 SeqID_VRC01=59.5
ATGVHSQVQLVQSGAEVKKPGASVKVSCKASGYTFTSYGISWVRQAPGQGLEWMGWISAYNGNTNYAQKLQGRVTMTTDTS
TSTAYMELRSLRSDDTAVYYCARGKYDYGWGVIVSGTSISWGRGTLVTVSSGSASRPNPFPSSPL >index=22829 germ=IGHV1-2*02 SeqID_VRC01=59.5
HSQVQLVQSGAVIKTPGSSVKISCRASGYNFRDYSIHWVRLIPDKGFEWIGWIKPLWGAVSYARQLQGRVSMTRQLSQDPDDP
DWGVAYMEFSGLTPADTAEYFCVRRGSCDYCGDFPWQYWGQGTVVVVSSAST
>index=34065 germ=IGHV1-2*02 SeqID_VRC01=59.5
HSQVQLVQSGAVIKTPGSSVKISCRASGYNFRDYSIHWVRLIPDKGFEWIGWIKPLWGAVSYARQLQGRVSMTRQLSQDPDDP
DWGVAYMEFSGLTPADTAEYFCVRRGSCDYCGDFPWQYWGQGTVVVVSSAST
>index=42537 germ=IGHV1-2*02 SeqID_VRC01=59.5
ATGVHSQVQLVQSGAVIKTPGSSVKISCRASGYNFRDYSIHWVRLIPDKGFEWIGWIKPLWGAVSYARQLQGRVSMTRQLSQDP
DDPDWGVAYMEFSGLTPADTAEYFCVRRGSCDYCGDFPWQYWGQGTVVVVSSAST VRC03    Signature insertion >index=57203 germ=IGHV1-2*02 SeqID_VRC01=59.5
TGVHSQVQLVQSGTEVKKPGASVMVTCKASGYSFNDYYVNWVRQAPGQGLEWMGWINPKTGDTNYARKFQGRVSMTRDTF
TTAYLELNSLTSDDTAVYYCVRGARGMPKGAFDIWGQGTLVIVSSA >index=64344 germ=IGHV1-2*02 SeqID_VRC01=59.504
ATGVHSQVQLVQSGAVIKTPGSSVKISCRASGYNFRDYSIHWVRLIPDKGFEWIGWIKPLWGAVSYARQLQGRVSMTRQLSQDP
DDPDWGVAYMEFSGLTPADTAEYFXVRRGSCDYCGDFPWQYWGQGTVVVVSSAPTKAHRSSPWPPSS VRC03-like >index=113877 germ=IGHV1-2*02 SeqID_VRC01=59.504
ATGVHSQVQLVQSGAEVKKPGASVKVSCKASGYTFTDYFVHWVRQAPGQNFEWMGWTQRNTGGTNYAPKFQGRVTMTRD
TSISTAYIELSGLTSDDTAVYYCARGDYDYLWGNYRFEYWGQGTLVTVSSASTKGPSVFPLAPSS

FIG. 115

Round 2: threading + clustering

- Top 10 sequence clusters ranked by threading score to VRC01 cluster 0: number of sequences=2716
>index=139116 size=127 identity=0.512
thread=0.093043
ATGVHSQVQLVQSGAEVKKPGASMRVSCQTSGYTFNSYYIH
WMRQVPGQGLEWMGWINPNSGYTNYTQKFQGRVTMTR
DTSINTAYLELSALRSDETAVYYCARDFSDGWPYSFDFWGQ
GTLVTVSS cluster 1: number of sequences=13
>index=107592 size=125 identity=0.504
thread=0.122210
ATGVHSQVQLVQSGTEVKKPGASVMVTCKASGYSFNDYYV
NWVRQAPGQGSPEWMGWINPKTGDTNYARKFQGRVSMT
RDTFINTAYIDLNKLKSDCTAVYYCAIGSGQFWLLMSWGRG
TVGHRLF cluster 2: number of sequences=623
>index=11518 size=130 identity=0.454
thread=0.126707
ATGVHSQVQLVQSGAEVKKPGASVKVSCKASGYSFTGYYIH
WLRQTPGQSPEWMGWINPNTGGANYAPNFEGRVTMTR
DTSTKTAYMELSRLRSDDTAFYYCAEGGVLLRGYYCFLLSWG
PGNAGDRLL cluster 3: number of sequences=18
>index=36194 size=127 identity=0.472
thread=0.130881
ATGVHSQVQLVQSGAEMKKPGASVKVSCKSTGYSLTGYYM
HWVRQAPGQGLEWMGWINPNNGATNYAQKFHQRVTMT
RDTSISAVYMELSRLKSEDTAMYFCARPMDESTTTIFDYWG
QGTLVAVSS cluster 4: number of sequences=12
>index=36540 size=128 identity=0.453
thread=0.131978
ATGVHSQVQLVQSGAEVKKPGASVKVSCQTSGYTSTGHYT
HWVRQAPGQRPEWMGWMNPNSGGTTFAPKFQGRITMT
RDTSTSTAYLEVRGLRADDTAVYYCARDYCSGGFCHYFFDS
WARDPGHRLL cluster 5: number of sequences=458
>index=34664 size=127 identity=0.465
thread=0.139909
ATGVHSQVQLVQSGAEVKKPGASVKVFCKASGYTFTSYGIS
WVRQAPGQGLEWMGWISAYNGHTNYPQKLQGRVTMTT
DTSTSTAYMELRSLRSDDTAVYYCARDRWLQPYYYYMDV
WARDHGHRLL cluster 6: number of sequences=3
>index=13899 size=123 identity=0.472
thread=0.142704
RCTFQVQLVQSGAEVKKPGSSVKVSCNVSGDTSRNYIFNW
VRQAPGQGLEWMGRFSPVFANPNYAQKFQGRVTITADEV
TRTTYVEIYNLRSEDTAVYYCARGDSSGWYSFDSWGQGTQ
VIVS cluster 7: number of sequences=17
>index=20489 size=126 identity=0.460
thread=0.143126
ATGVHSQVQLVQSGTDVRKPGASVKVSCKASGYTFSDYYI
HWVRQAPGQRLEWIGWFNPNTGGAHYGLDYQGRVTMT
GDELTRTTYVELSSLRSEDTAVYYCARGDSSGWYSFDSVGP
GNAWSSSP cluster 8: number of sequences=27
>index=27665 size=129 identity=0.450
thread=0.143421
CNRCTSQVQLVESGGGLVKPGGSLRLSCAASGFTFSDYYMS
WIRQAPGKGLEWVSYISSSGSTIYYADSVKGRFTISRDNAKN
SLYLQMNSLRAEDTAVYYCARGYYYDSSGTFGYWGQGTLV
TVSSGS cluster 9: number of sequences=75
>index=109562 size=118 identity=0.475
thread=0.144782
ATGVHSQVQLVQSGTEVKKPGSSVKVSCKASGVALTSFTFS
WVRQAPGQGLEWMGWINPNSGGTNYAQKFHGRVTLTR
DTSIGTAYMELSRLTSDDTAVYYCVRASTNGPSPVLPPWP

FIG. 116

Round 3: 2*02 lineage + divergence

- Top 10 sequence clusters ranked by their sequence divergence relative to 2*02 cluster 0: number of sequences=6
>index=12853 germ=IGHV1-2*02 divergence=0.209
ATGVHSQVQLVQSGTEVKKSGASLKISCMTAGYTFSAHYIHWV
RQAPGQGLEWMGWINPATGDTKFVQTFQGRLAMTRDTTDTV
NLLASVKPNDTATYYCARDWQFQVTFGDFYMDWGNGTTVIVX
cluster 1: number of sequences=4
>index=127918 germ=IGHV1-2*02 divergence=0.209
ATGVHSQVQLVQSGDADLRNPGASVKVSCKASGYIFKNQYIHWV
RQAPGQGFEWMGHLNPWSGGTVYAQKFQDRLSMTRDMSTST
AYMELRSLTSDDTANLLLTAILVSSTWGQGTWSPSPX
cluster 2: number of sequences=3
>index=25055 germ=IGHV1-2*02 divergence=0.206
ATGVHSQVQLVQSGADVKKPGTSVKVSCKASGDAFSDYYLHW
VRQVPGQGLEWMGWIMDPMNGATMYAPKFQGMIIMTRDTSINT
VYLELRRLRSDTAYYFCTRDASGPQTYYYDSSGFEFDSWGQ
GTLVIVSSASTX
cluster 3: number of sequences=2
>index=60412 germ=IGHV1-2*02 divergence=0.196
HSQVQLVSGTEMKKSGASLKVSCKTSGYTFSAHYIHWVRQAPG
QGLEWMGWINPDSGDTNFAQTFQGRTTLTRDAFAMTVNLLLAS
LKPNDTATYYCARDWQFQGTFGDFYMDWGNGTTVIVSQPPPG
PSVFPWPPSSKTHLVGAR
cluster 4: number of sequences=1
>index=25949 germ=IGHV1-2*02 divergence=0.186
ATGVHSQVQLVQSGTEMKKSGASVKVSCETSGYTFTAYYIHWV
RQAPGQRGLEWMGWINPDSGGTKFARTFQGRTTVTRDTSTNTV
NLLASLQSNDTATYYCARDWQFQVTFGDYYMDWGNGTTVIV
SPASTKAHRSSPGTLLQDAPLGHSGLGCLVX cluster 5: number of sequences=1
>index=26177 germ=IGHV1-2*02 divergence=0.186
ATGVHSQVQLVQSGTKMMKSGASMKVPCKTSGYTFTAYYIHW
VRQAPGRGLEWMGWINPDSGDTNFAQTFKDRVNMTRDTSTTT
VNLVLVNLRSDDTATYYCARDWQYQVIFGDFYLDWGNGTTVIV
VSSLHQGPSVFPLATLLQRRHL
cluster 6: number of sequences=47
>index=19531 germ=IGHV1-2*02 divergence=0.182
ATGVHSQVQLVQSGAEVKKPGASVKVSCQASGYRFTDQHLNWI
RQAPGQGFEWLGRFMPANGGTDLAQKFQGRVSMTRNMSITTA
YLELSRLTSDDTATYYCLNSGWTNEYHYDHWGQGTPVTVSS
cluster 7: number of sequences=169
>index=18715 germ=IGHV1-2*02 divergence=0.182
CNRCTSQVQLVQSGAEVKKTGASVRVSCETSGYPFTNHYIHWV
RQAPGHGLEWMMAWINPSGGATIYAEAFEGRIMVSSDTSLNTVY
MELESLTSGDTAMYFCARDATPITTEFDRWGQGHSPSPQPPPR
PIGPSPSATLLQRRHL
cluster 8: number of sequences=1
>index=59966 germ=IGHV1-2*02 divergence=0.172
ATGVHSQVQLVSRGLKRSLGPQRSPVRLLDTDSPTNIIGYDRPP
GQGFEWLGRFNPAMGGTBLAQKFQGRVSMTRNMSITTAYLELS
RLTSDDTATYYCLNSGWTNEYHYDHWGQGTPVTVSSRLHQ
cluster 12: number of sequences=3
>index=10302 germ=IGHV1-2*02 divergence=0.172
ATGVHSQVQLVQSGAEVKKPGASVKVSCQASGYRFTDQHFEL
DTTGPWTRWAGQVQPQQWRHRSCTEVSGVSMTRNMSITTAY
LELSRLTSDDTATYYCLNSGRMNITMTTWGQGTPVTVSSRLHX

NEUTRALIZING ANTIBODIES TO HIV-1 AND THEIR USE

CROSS REFERENCE TO RELATED APPLICATIONS

This is a continuation of International Application No. PCT/US2010/050295, filed Sep. 24, 2010, which in turn claims the benefit of U.S. Provisional Application No. 61/385,531, filed Sep. 22, 2010, U.S. Provisional Application No. 61/402,314, filed Aug. 27, 2010, U.S. Provisional Application No. 61/346,808, filed May 20, 2010, U.S. Provisional Application No. 61/290,135, filed Dec. 24, 2009, U.S. Provisional Application No. 61/252,613, filed Oct. 16, 2009, and U.S. Provisional Application No. 61/246,039, filed Sep. 25, 2009. All of these provisional applications are specifically incorporated by reference in their entirety.

FIELD OF THE DISCLOSURE

This relates to monoclonal neutralizing antibodies that bind to the CD4 binding site of HIV-1 gp120 or to HIV-1 gp41, their identification, and their use.

BACKGROUND

An effective HIV-1 vaccine will likely need to induce neutralizing antibodies (NAbs) that block HIV-1 entry into human cells. To be effective, vaccine induced antibodies will have to be active against most circulating strains of HIV-1. Unfortunately, current HIV-1 vaccines are unable to induce potent and broadly reactive NAbs. One major obstacle to the design of better vaccines is the limited understanding of what region of the HIV-1 envelope glycoproteins (gp120 and gp41) are recognized by NAbs. A few neutralizing monoclonal antibodies (mAbs) have been isolated from HIV-1 infected individuals and these mAbs define specific regions (epitopes) on the virus that are vulnerable to NAbs.

One previously characterized HIV-1 neutralizing mAb, called b12, can bind to a site on gp120 that is required for viral attachment to its primary cellular receptor, CD4. Another previously characterized HIV-1 neutralizing mAb, called 2F5, can bind to a site on gp41. mAb b12 was derived from a phage display library, a process which makes it impossible to know if the antibody was naturally present in an infected person, or was the result of a laboratory combination of antibody heavy and light chains. b12 can neutralize about 75% of clade B strains of HIV-1 (those most common in North America), but it neutralizes less than 50% of other strains of HIV-1 found worldwide. Prior attempts to design a vaccine that induces NAbs similar to b12 have been unsuccessful. Therefore, there is a need to develop Nabs for HIV-1.

SUMMARY OF THE DISCLOSURE

Isolated human monoclonal neutralizing antibodies that specifically bind HIV-1 gp120 or gp41 are provided herein. Also disclosed herein are compositions including these antibodies that specifically bind gp120- or gp41-nucleic acids encoding these antibodies, expression vectors comprising the nucleic acids, and isolated host cells that express the nucleic acids. In some embodiments, the heavy chain of the isolated human monoclonal antibody includes amino acids 26-33 (complementarity-determining region 1 (CDR1)), 51-58 (CDR2), and 97-110 (CDR3) of SEQ ID NO: 1, wherein the antibody specifically binds gp120 of HIV-1, and wherein the antibody is neutralizing. In other embodiments, the heavy chain of the isolated human monoclonal antibody includes amino acids 26-35 (CDR1), 50-66 (CDR2), and 106-119 (CDR3) of SEQ ID NO: 27, wherein the antibody specifically binds gp120 of HIV-1, and wherein the antibody is neutralizing. In other embodiments, the heavy chain of the isolated human monoclonal antibody includes CDR1, CDR2, and CDR3 of any one of SEQ ID NOs: 760-1459, wherein the antibody specifically binds gp120 of HIV-1, and wherein the antibody is neutralizing. In still other embodiments, the heavy chain of the antibody includes SEQ ID NO: 5, wherein one or more of amino acids 106, 107, or 109 of SEQ ID NO: 5 are substituted with a tryptophan, and wherein the antibody specifically binds gp41 of HIV-1 and is neutralizing.

The antibodies and compositions disclosed herein can be used for a variety of purposes, such as for detecting an HIV-1 infection or diagnosing AIDS in a subject. These methods can include contacting a sample from the subject diagnosed with HIV-1 or AIDS with a human monoclonal antibody that specifically binds gp120 or gp41, and detecting binding of the antibody to the sample. An increase in binding of the antibody to the sample relative to binding of the antibody to a control sample confirms that the subject has an HIV-1 infection and/or AIDS. In some embodiments, the methods further comprise contacting a second antibody that specifically binds gp120 or gp41 with the sample, and detecting binding of the second antibody. In some non-limiting examples an increase in binding of the antibody to the sample relative to a control sample detects HIV-1 in the subject. In some non-limiting examples, the antibody specifically binds soluble gp120 in the sample. In some embodiments, the methods further comprise contacting a second antibody that specifically recognizes the 120- or gp41-specific antibody with the sample and detecting binding of the second antibody.

In additional embodiments, a method is disclosed for treating a subject with an HIV infection, such as, but not limited to, a subject with AIDS. The methods include administering a therapeutically effective amount of a human gp120 or gp41 specific monoclonal antibody to the subject.

The foregoing and other features and advantages of this disclosure will become more apparent from the following detailed description of a several embodiments which proceeds with reference to the accompanying figures.

BRIEF DESCRIPTION OF THE FIGURES

FIG. 1A is a surface structure model of the RSC3. The outer domain contact site for CD4 is highlighted in light grey. Regions highlighted dark are antigenically resurfaced areas, shown both on the inner (left panel) and outer (right panel) faces of the core protein. Glycans are shown in medium grey. FIG. 1B is a set of graphs showing the antigenicity of the RSC3 protein based on enzyme-linked immunosorbent assay (ELISA) using the neutralizing CD4bs mAb b12 and CD4-Ig fusion protein. mAb 2G12 was used to confirm the structural integrity of the protein. FIG. 1C is a set of graphs showing the results of kinetic binding analysis in which mAb b12 was immobilized on the sensor chip for surface plasmon resonance (SPR) kinetic binding analysis with the proteins shown. FIG. 1D is a set of graphs showing the RSC3 blockade of HIV-1 viral strain HXB2 neutralization by the broadly neutralizing CD4bs mAb b12, but not CD4bs mAb F105, which has limited neutralization breadth. The V3 neutralizing mAb 447-52D is shown as a control. FIG. 1E is a set of bar graphs showing the analysis of serum 45 neutralization of a panel of 17 viruses, using RSC3 and ΔRSC3 to block neutralization activity. The percent reduction in the serum ID50 caused by competition with RSC3 or ΔRSC3 is shown on the Y-axis (+/−SEM of three independent experiments). Viral strains and clades are shown on the X-axis. Values less than 20% were not considered significant in this assay.

FIGS. 2A-2C are a set of dot plots and graphs showing isolation of individual CD4bs-directed memory B cells by cell sorting, and binding characterization of isolated mAbs. FIG. 2A is a set of dot plots of flow cytometry data showing the results of twenty-five million peripheral blood mononuclear cells (PBMC) from donor 45 that were incubated with biotin-labeled RSC3 and ΔRSC3 complexed with SA-APC and SA-PE respectively, prior to addition to cells. Memory B cells were selected based on the presented gating strategy. Twenty-nine B cells that reacted with RSC3 and not ΔRSC3 (representing 0.05% of all memory B cells) were sorted into individual wells of a 96 well plate containing lysis buffer. FIG. 2B is a set of graphs of the results of an ELISA antigen binding profile of three isolated mAbs, VRC01, VRC02 and VRC03. Solid lines show mAb binding to RSC3 (left panel) and YU2 gp120 (right panel). Dashed lines indicate binding to ΔRSC3 (left) or to the CD4bs knockout mutant of gp120, D368R (right). FIG. 2C is a set of graphs of the SPR binding analysis of VRC01 reacted with RSC3 and ΔRSC3. VRC01 was captured with an anti-human IgG-Fc antibody that was immobilized on the sensor chip.

FIGS. 3A and 3B are a set of graphs and a table showing the antigenic and biophysical characterization of novel CD4bs-directed mAbs. FIG. 3A is a set of graphs of results of competition ELISA performed with a single concentration of biotin-labeled VRC01 (left) or the co-receptor binding mAb 17b (right). The mAbs indicated near each line were titrated into the ELISA at increasing concentrations to evaluate the effect on VRC01 and 17b binding, respectively. FIG. 3B is a table showing the results of isothermal titration calorimetry (ITC) used to assess the change in enthalpy (ΔH) and entropy (−TΔS) upon binding of mAbs to YU2 gp120. Each measured value is shown +/−SEM.

FIG. 4 is set phylogenetic trees showing the analysis of neutralization by mAbs VRC01 and b12 against a panel of 190 Env pseudoviruses representing all major circulating clades of HIV-1. Dendrograms, made by the neighbor-joining method, show the protein distance of gp160 sequences from 190 HIV-1 primary isolates. The clade B reference strain HXB2 was used to root the tree, and the amino acid distance scale is indicated with a value of 1% distance as shown. The clades of HIV-1 main group, including circulating recombinant forms (CRFs), are indicated. The data under the dendrograms show the percent of viruses neutralized with an IC50<50 μg/ml, and <1 μg/ml, and the geometric mean IC50 value for viruses neutralized with an IC50<50 μg/ml.

FIG. 5A is a schematic drawing showing an algorithm of structure-based design of the resurfaced core proteins. The design intent was to resurface non-CD4bs regions of the core protein, and to maintain the b12 contact surface while abrogating CD4 binding.

FIG. 6 is a table showing the design and expression of resurfaced core (RC) and resurfaced stabilized core (RSC) glycoproteins, and summary of antigenic reactivity. A panel of 8 resurfaced proteins with different degrees of resurfacing were designed and tested. The surface structural model of each resurfaced protein is shown. Each protein was analyzed for binding to CD4-Ig, b12 and 2G12. 2G12 binding was used as a marker of conformational integrity of the purified protein. ELISA binding activity was categorized as strong (+++), moderate (++), weak (+) or negative (−). RSC3, used subsequently to isolate mAbs, was 31.3% antigenically resurfaced and maintained strong binding to b12.

FIG. 7 is a table showing the results of binding to RSC3 protein by a panel of neutralizing sera. Fifteen clade B sera with moderate to broad neutralizing activity were evaluated by ELISA for binding to RSC3 and ΔRSC3. Neutralization of five viral isolates is shown; the clade of each virus is indicated in parenthesis. Neutralization ID50 values greater than 1000 are highlighted in dark boxes; values between 100-1000 are highlighted in light boxes. ELISA binding was categorized as strong (+++), moderate (++), weak (+) or negative (−). Preferential binding to RSC3, compared to ΔRSC3, is evidence of CD4bs directed antibodies in the sera. Donor 45 was chosen for additional serum analysis, and eventually for isolation of mAbs.

FIG. 8 is a set of graphs showing the comparison of VRC01 and b12 binding kinetics by surface plasmon resonance (SPR). The mAbs were captured with a mouse anti-human IgG Fc antibody that was immobilized onto the chip matrix. The binding kinetics of ligands RSC3, ΔRSC3, stabilized core and full-length YU2 gp120 were analyzed.

FIG. 9 is a set of graphs showing the VRC02 and VRC03 binding kinetics by SPR. The mAbs were captured with a mouse anti-human IgG Fc antibody that was immobilized onto the chip matrix. The binding kinetics of ligands RSC3, ΔRSC3, stabilized core and full-length YU2 gp120 were analyzed.

FIG. 10A is a table showing a gene family analysis of VRC01, VRC02, VRC03 and b12. The VH and VK mutation frequency was calculated from the mutated nucleotides. Mean values from three normal donors consisted of 120 IgD+ CD27+ and 97 IgDCD27+ sequences for heavy chain analysis and 167 mutated IgM+ sequences for kappa analysis are shown. A specific D gene could not be determined since the germline genes with the greatest homology (IGHD3/OR15-3, IGHD3-22 or IGHD3-16) each contained a mutation within a matching length of less than 11 nucleotides and the orphan IGHD3/OR15-3 gene on chromosome 15 cannot contribute to Ig chain synthesis; bIGHJ2*01 is an alternative possibility based on the third complementarity determining region 3 (CDR3) sequence analysis; cIGKV3-NL1*01 (NL=Not Located) showed greater homology than IGKV3-11*01 by one nucleotide; dIGKV3-NL5*01 showed greater homology than IGKV3-20*01 by one nucleotide.

FIG. 10B is sequence alignment of the deduced amino acid sequences of the variable regions of VRC01 (heavy chain, SEQ ID NO: 1; light chain, SEQ ID NO: 2), VRC02 (heavy chain, SEQ ID NO: 3; light chain, SEQ ID NO: 4) and VRC03 (heavy chain, SEQ ID NO: 27; light chain, SEQ ID NO: 28). Framework (FR) and CDRs are indicated above the sequence alignment. The top sequence in each group represents the deduced germline sequence with identity to the expressed VH1, D3, JH1, VK3 and JK2 genes. VRC01, VRC02 and VRC03 were derived from the same VH germline gene (IGHV1-02*02, SEQ ID NOs: 41, 42), hence all 3 mAbs are aligned to this sequence. VRC01 and VRC02 are somatic variants of each other (they have the same V-D-J recombination). The arrow marks the position of a 7 amino acids insertion (QLSQDPD, SEQ ID NO: 27) in the VRC03 heavy chain FR3 region. A common motif is underlined in the heavy chain CDR1 (GYXFXD, SEQ ID NO: 27), CDR2 (KPXXGAV, SEQ ID NO: 27) and CDR3 (CDYXXDF, SEQ ID NO: 27). VRC01 and VRC02 have the same VK gene (IGKV3-11*01, SEQ ID NO: 42). While the closest inferred germline sequence match for VRC03 was IGKV3-20*01 (SEQ ID NO: 43), IGKV3-11*01 was also a close match. The dot symbol marks an amino acid deletion in the VK CDR1.

The arrows mark the position of a 2 amino acids insertion (VQ) in VRC01 and VRC02 FR4 (JK gene). Light residues indicate replacement substitutions compared to germline sequence.

Figure 11A:
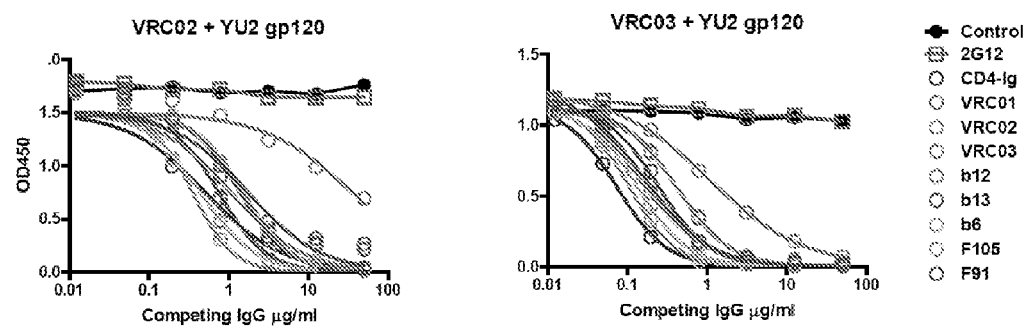

FIG. 11A is two graphs showing the results of competition ELISA performed with a single concentration (50 ng/ml) of biotinylated VRC02 or VRC03 binding to YU2 gp120. The unlabeled competing mAbs were titrated into the ELISA at increasing concentrations to evaluate the effect on VRC02 and VRC03 binding respectively.

Figure 11B:
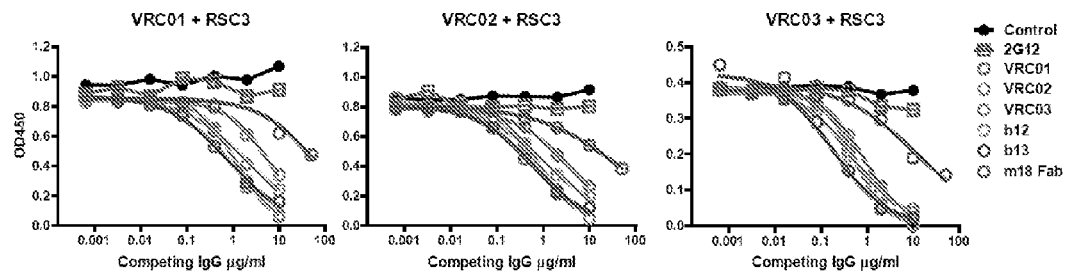

FIG. 11B are three graphs showing the results of competition ELISA performed with a single concentration (50 ng/ml) of biotinylated VRC01, VRC02 or VRC03 binding to RSC3. The unlabeled competing mAbs were limited to those that showed binding to RSC3.

Figure 11C:
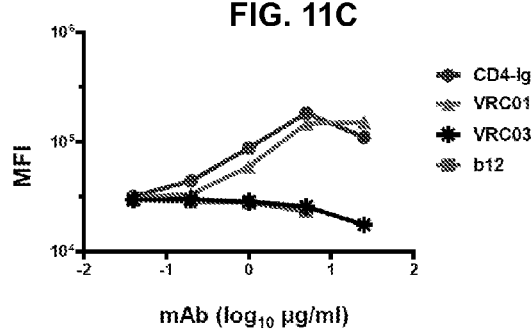

FIG. 11C is a graph showing the results of analysis of gp120 binding to cell surface expressed CCR5 by flow cytometry. Biotinylated gp120 at 5 µg/ml was used to stain the human CCR5 expressing canine thymus cell line, Cf2Th/syn CCR5. Prior to cell staining, biotinylated gp120 was incubated with CD4-Ig or mAbs VRC01, VRC03 or b12 with serial concentrations ranging from 0.04-25 µg/ml. Binding of gp120 was detected by streptavidin-APC and FACS analysis. Note that CD4-Ig and VRC01 enhanced gp120 binding to CCR5, while mAbs b12 and VRC03 did not.

FIGS. 12A and 12B are a set of graphs showing analysis of the effect of VRC01 on the functional viral spike. FIG. 12A is a set of graphs showing the neutralization of JRFL that was performed with the mAbs shown in the legend. Antibody 447-52D is directed to the V3 region of gp120, and mAbs 17b and vc813 DB are directed to the co-receptor binding region of gp120. Graphs show the effect on neutralization as sCD4 (left panel) or VRC01 (right panel) were added to the assay. The adjusted neutralization was calculated using the baseline of viral entry at each concentration of sCD4 or VRC01. In contrast to sCD4, VRC01 did not enhance the neutralization by mAbs 447-52D, 17b and vc813 DB. FIG. 12B is a set of graphs showing JRFL entry into the CCR5+/CD4– cell line, Cf2Th/syn CCR5. CD4-Ig and sCD4 (left panel) promote entry of JRFL into CD4 negative cells. VRC01 (right panel) did not promote viral entry. Each infection was performed in triplicate, and the mean and standard error are shown.

FIGS. 13A and 13B are a table and a graph showing correlation analysis of neutralization by serum 45 IgG and mAb VRC01. FIG. 13A is a contingency table showing neutralization by serum 45 IgG and mAb VRC01. Fisher's exact test demonstrated a strong association between the number of viruses neutralized by serum 45 IgG and mAb VRC01. Serum 45 IgG sensitive was defined as an IC50<1000 µg/ml. VRC01 sensitivity was defined as an IC50<50 µg/ml. FIG. 13B is a graph of a deming regression analysis of log transformed IC50 values of viruses neutralized by both VRC01 and serum 45 IgG. This showed a strong association between the potency of serum 45 IgG and mAb VRC01. The slope of the regression line is 0.68 (95% CI 0.07). Thus, while VRC01 accounts for a substantial portion of total serum 45 IgG neutralization, the slope of less than 1.0 suggests that VRC01 does not account for all serum 45 IgG neutralization activity.

FIG. 14 is Table S1 showing the ELISA binding profiles of VRC01, VRC02, and VRC03 compared to a panel of known mAbs.

FIG. 15 is Table S2a showing a summary of the breath and potency of antibody neutralization against 190 HIV-1 Env-pseudoviruses.

FIG. 16 is Table S2b showing antibody neutralization data against 22 HIV-1 clade A HIV-1 Env-pseudoviruses.

FIG. 17 is Table S2c showing antibody neutralization data against 49 HIV-1 clade B HIV-1 Env-pseudoviruses.

FIG. 18 is Table S2d showing antibody neutralization data against 38 HIV-1 clade C HIV-1 Env-pseudoviruses.

FIG. 19 is Table S2e showing antibody neutralization data against 8 HIV-1 clade D HIV-1 Env-pseudoviruses.

FIG. 20 is Table S2f showing antibody neutralization data against 18 HIV-1 CRF01_AE Env-pseudoviruses.

FIG. 21 is Table S2g showing antibody neutralization data against 16 HIV-1 CRF02_AG Env-pseudoviruses.

FIG. 22 is Table S2h showing antibody neutralization data against 10 HIV-1 clade G Env-pseudoviruses.

FIG. 23 is Table S2i showing antibody neutralization data against 11 HIV-1 CRF07_BC Env-pseudoviruses.

FIG. 24 is Table S2j showing antibody neutralization data against 18 Env-pseudoviruses.

FIG. 25 is Table S3 showing IC50 titers (µg/ml) of antibody neutralization against selected HIV-1 clade B and C viruses using Env-pseudoviruses to infect TZM-b1 or activated PBMC, and using PBMC derived uncloned primary isolates to infect TZM-b1 or activated PBMC.

Figure 26:
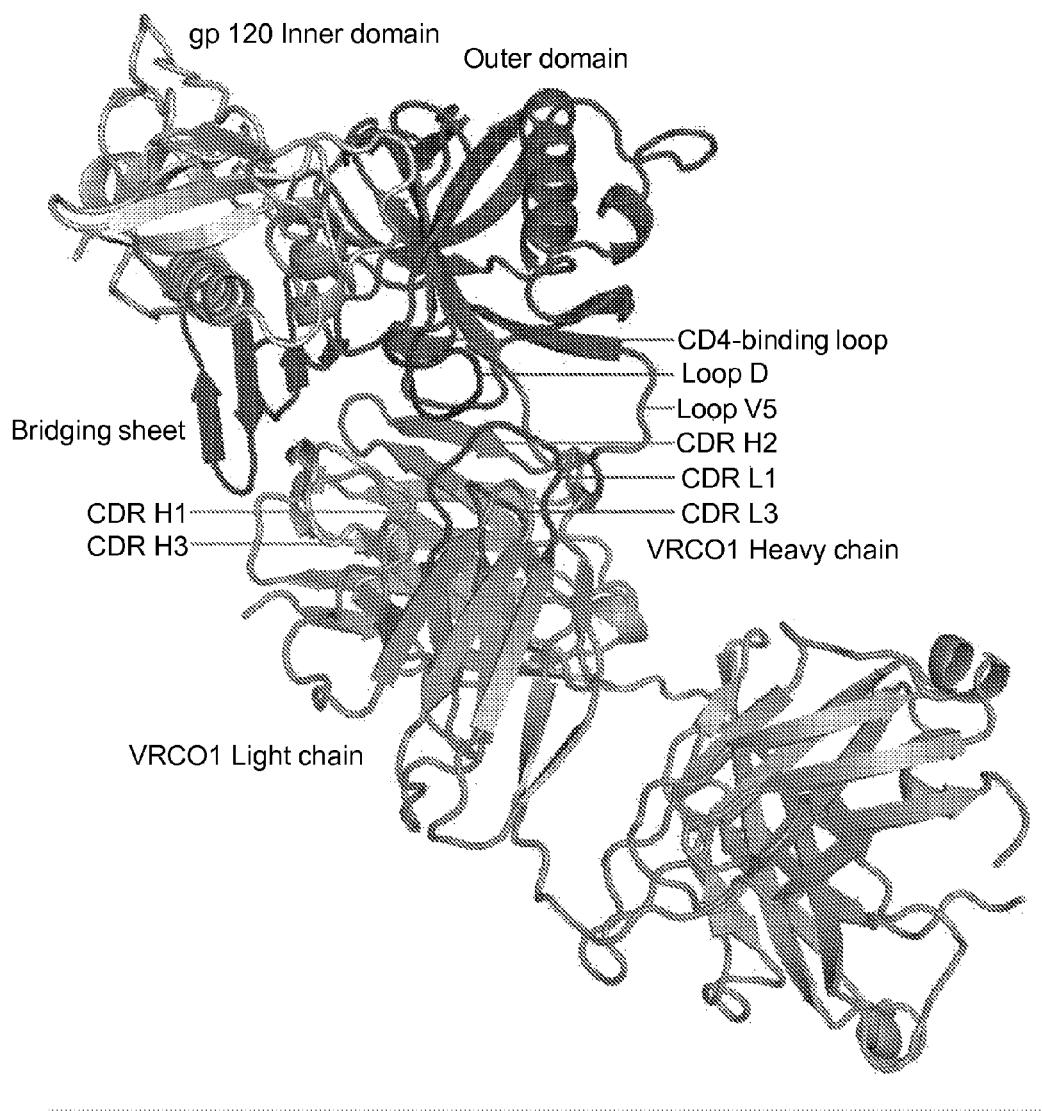

FIG. 26 is an electronic image of a depiction of the structure of antibody VRC01 in complex with HIV-1 gp120. Atomic-level details for broad and potent recognition of HIV-1 by a natural human antibody are depicted with polypeptide chains in ribbon representations. Both light and heavy chains of VRC01 interact with gp120: the primary interaction surface is provided by the CDR H2, with the CDR L1 and L3 and the CDR H1 and H3 providing additional contacts.

Figure 27B:
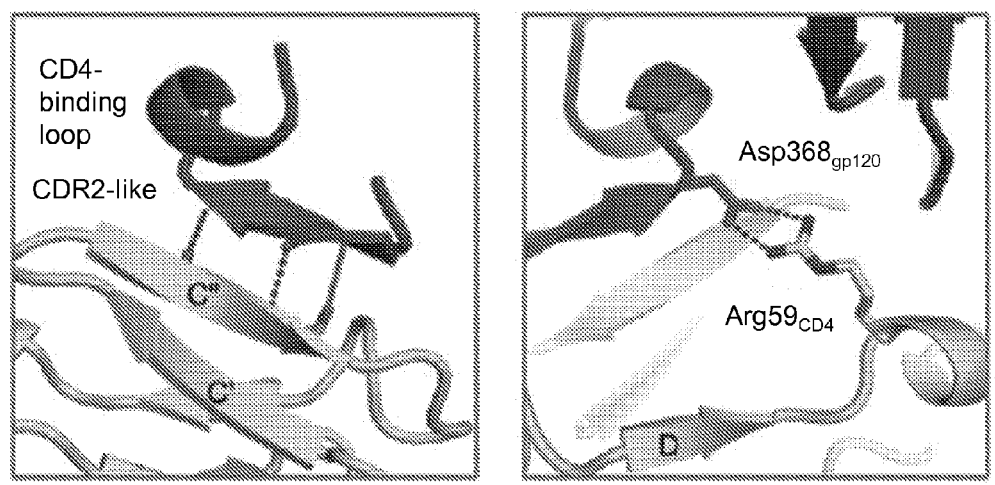
Figure 27C:
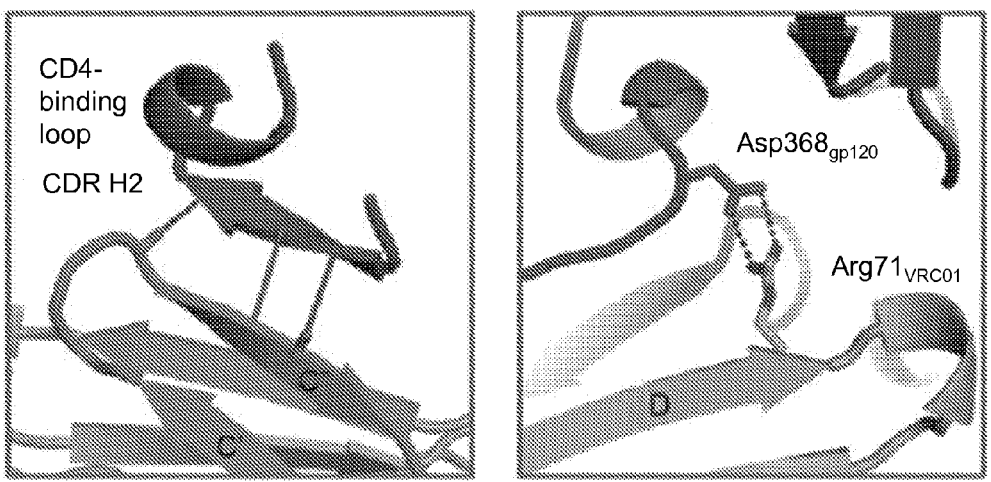
Figure 27D:
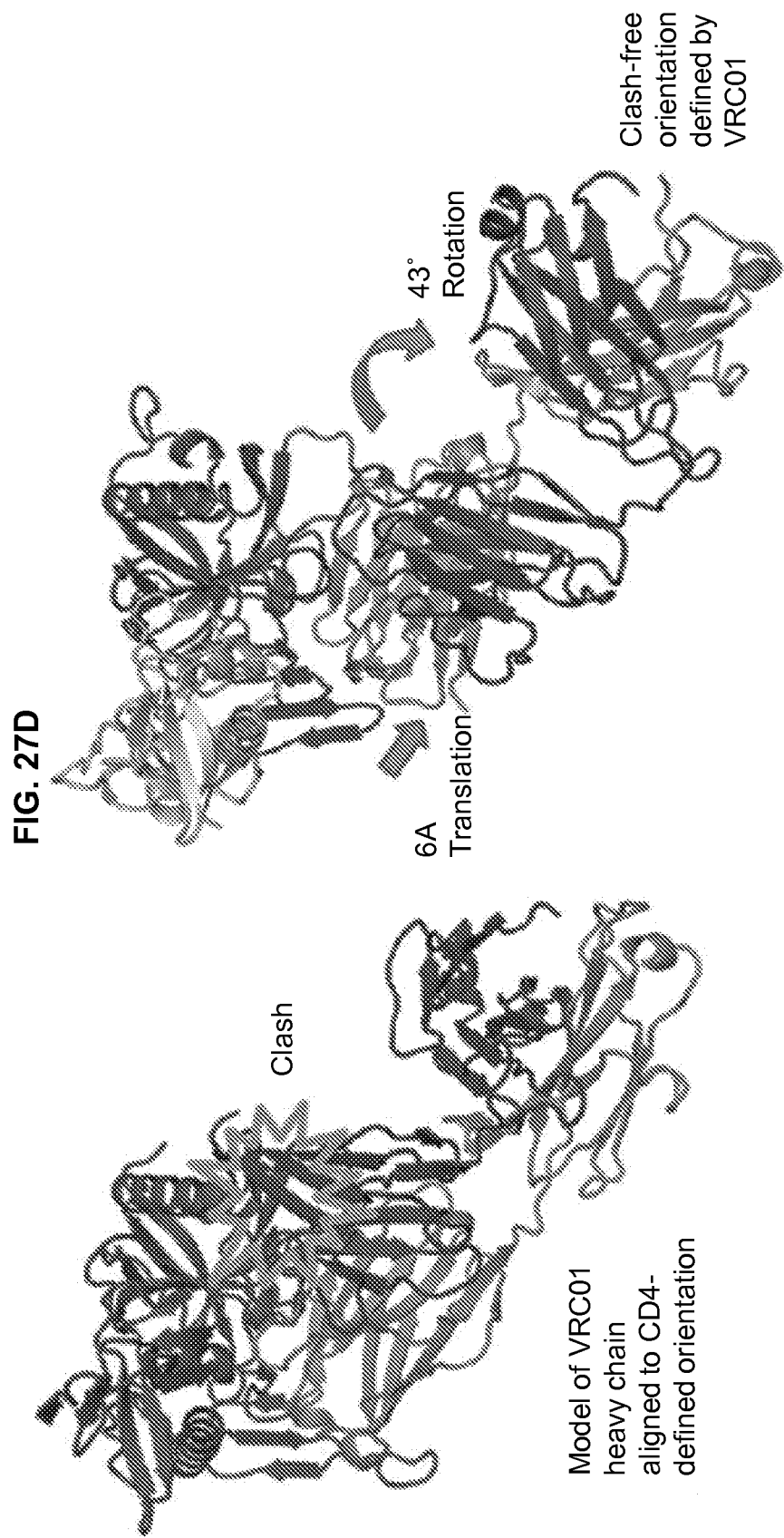

FIGS. 27A-27D are a set of electronic images depicting the structural mimicry of CD4 interaction by antibody VRC01. VRC01 shows how a double-headed antibody can mimic the interactions with HIV-1 gp120 of a single-headed member of the immunoglobulin superfamily such as CD4. FIG. 27A is a comparison of HIV-1 gp120 binding to CD4 (N-terminal domain) and VRC01 (heavy chain-variable domain). Polypeptide chains are depicted in ribbon representation for the VRC01 complex (right) and the CD4 complex with the lowest gp120 RMSD (left). Immunoglobulin domains are composed of two β-sheets, and the top sheet of both ligands is labeled with the standard immunoglobulin-strand topology (strands G, F, C, C', C"). Close-ups are shown of critical interactions between the CD4-binding loop and the C" strand as well as between Asp368gp120 and either Arg59CD4 or Arg71VRC01. Atoms from which hydrogen bonds extend are depicted in stick representation. In the left panel of C, the β15-strand of gp120 is depicted to aid comparison with FIG. 27B, though because of the poor hydrogen-bond geometry, it is only a loop. FIG. 27D shows the comparison of VRC01- and CD4-binding orientations. When the heavy chain of VRC01 is superimposed onto CD4 in the CD4-gp120 complex, the position assumed by the light chain evinces numerous clashes with gp120 (left). The VRC01-binding orientation (right) avoids clashes by adopting an orientation rotated by 43° and translated by 6-Å.

Figure 28A:
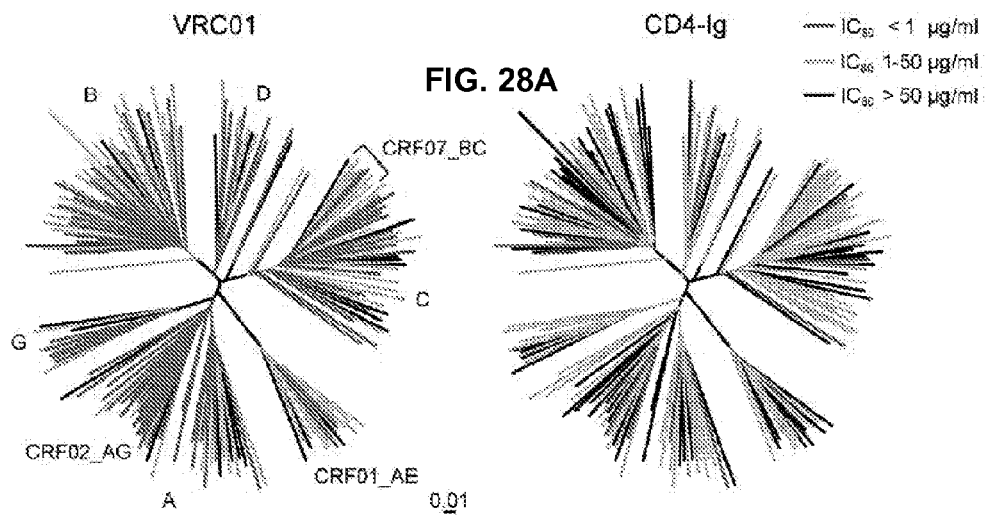
Figure 28B:
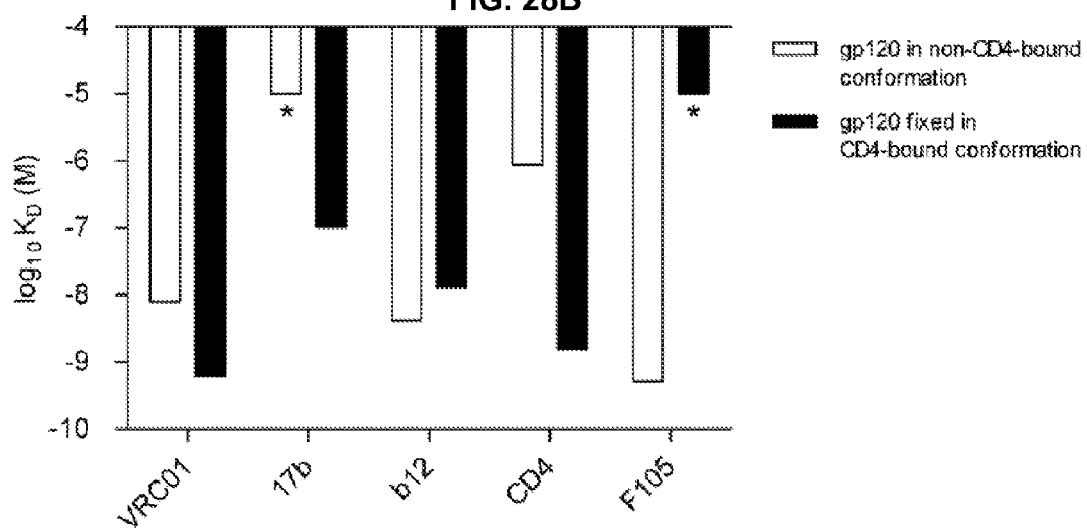
Figure 28C:
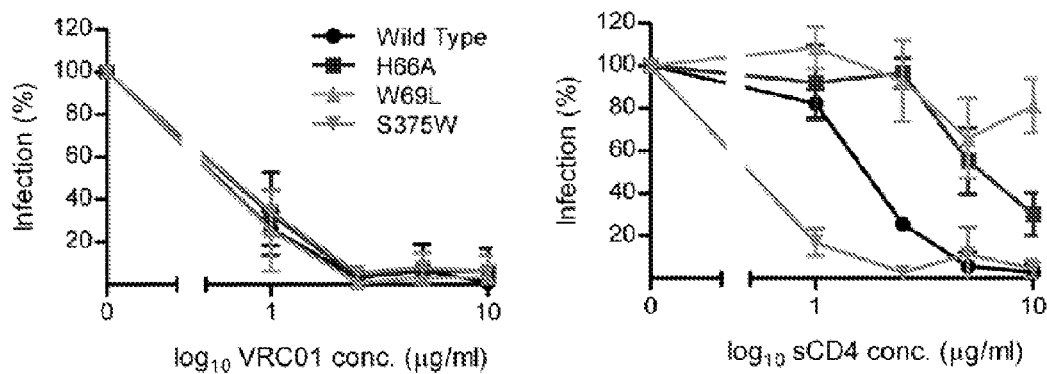

FIGS. 28A-28C are a dendrogram, a bar graph, and a set of graphs showing structural basis of antibody VRC01 neutralization breadth and potency. VRC01 displays remarkable neutralization breadth and potency, a consequence in part of its ability to bind well to different conformations of HIV-1 gp120. FIG. 28A shows neutralization dendrograms. The genetic diversity of current circulating HIV-1 strains is displayed as a dendrogram, with locations of prominent clades (e.g. A, B and C) and recombinants (e.g., CDR02_AG) labeled. VRC01 neutralizes 72% of the tested HIV-1 isolates with an IC80 of less than 1 ug/ml; by contrast, CD4 neutralizes 30% of the tested HIV-1 isolates with an IC80 of less than 1 ug/ml. FIG. 28B shows a comparison of binding affinities. Binding affinities (KDs) for VRC01 and various other gp120-reactive ligands as determined by surface-plasmon resonance are shown on a bar graph. White bars represent affinities for gp120 restrained from assuming the CD4-bound state and black bars represent affinities for gp120 fixed in the CD4-bound state. Binding too weak to be measured accurately is shown as with an asterisk and bar at $10^{-5}$ M KD. FIG. 28C shows the neutralization of viruses with altered sampling of the CD4-bound state. Mutant S375Wgp120 favors the CD4-bound state, whereas mutants H66Agp120 and W69Lgp120 disfavor this state. Neutralization by VRC01 (left) is similar for wild-type (WT) and all three mutant viruses, whereas neutralization by CD4 (right) correlates with the degree to which gp120 in the mutant viruses favors the CD4-bound state.

FIGS. 29A-29D are electronic images depicting the natural resistance to antibody VRC01. VRC01 precisely targets the CD4-defined site of vulnerability on HIV-1 gp120. Its binding surface, however, extends outside of the target site, and this allows for natural resistance to VRC01 neutralization. FIG. 29A shows the target site of vulnerability. The CD4-defined site of vulnerability is the initial contact surface of the outer domain of gp120 for CD4 and comprises only two-thirds of the contact surface of gp120 for CD4. The view shown here is rotated 90° about the horizontal from the view in FIGS. 26 and 27. FIG. 29B shows VRC01 recognition. The variable domains of VRC01 are shown in ribbon representation. FIG. 29C shows antigenic variation. FIG. 29D, shows a molecular surface of VRC01 and select interactive loops of gp120. Variation at the tip of the V5 loop is accommodated by a gap between heavy and light chains of VRC01.

Figure 30A:
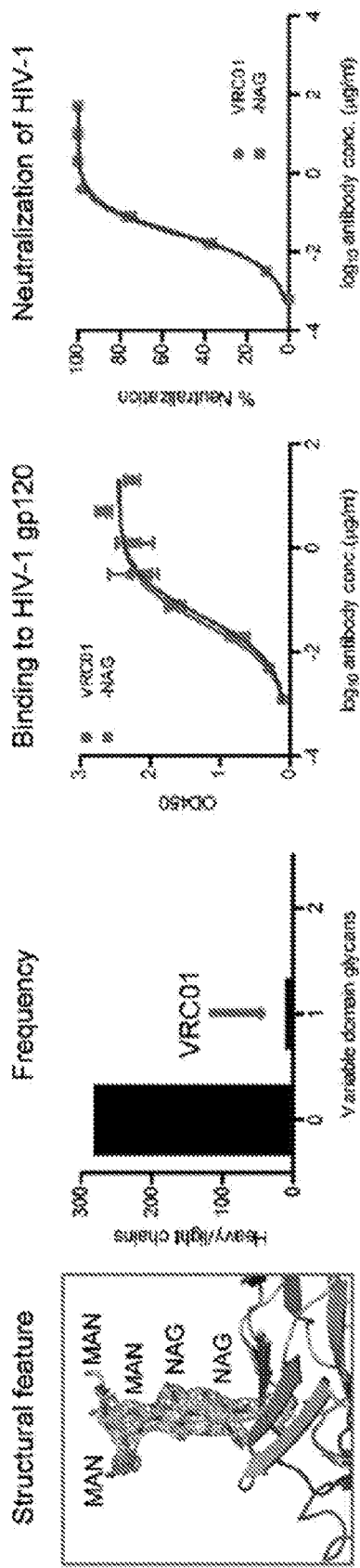
Figure 30B:
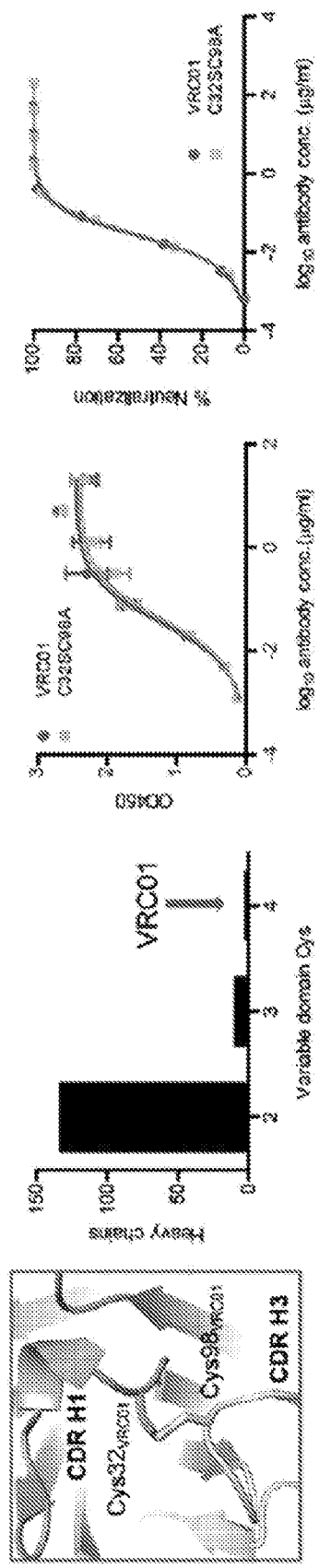
Figure 30C:
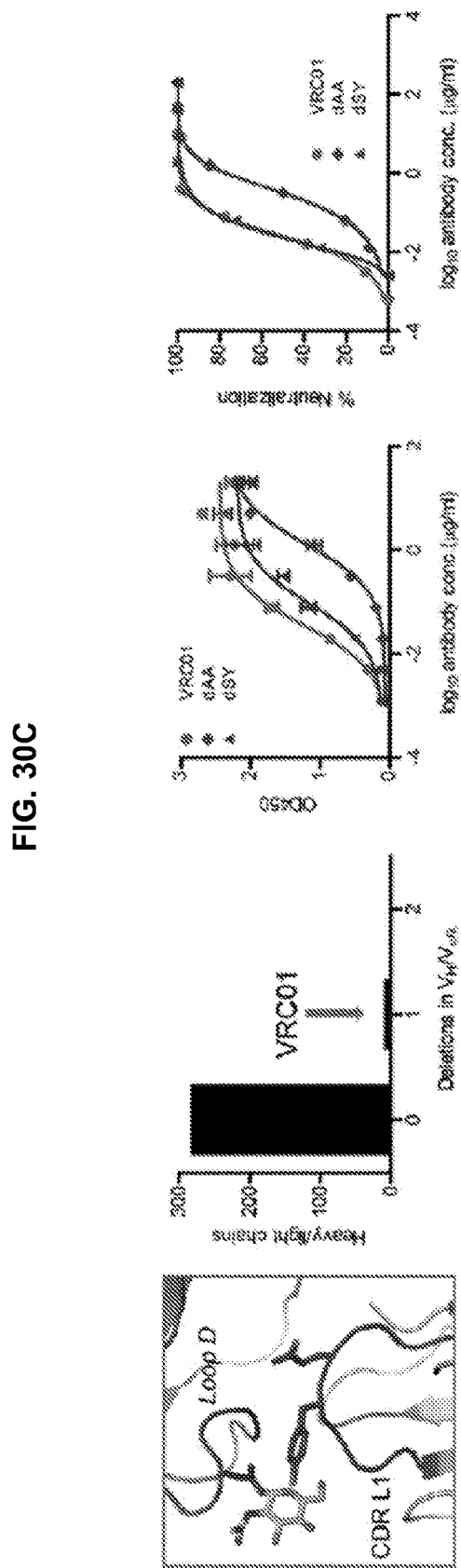
Figure 30D:
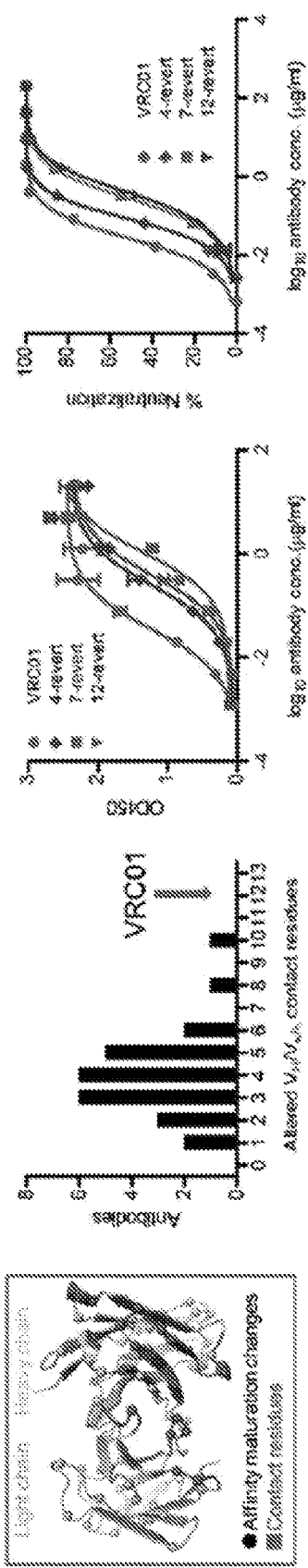

FIGS. 30A-30D are a set of electronic images, bar graphs and graphs depicting the unusual VRC01 features. The structure of VRC01 displays a number of unusual features, which if essential for recognition might inhibit the elicitation of VRC01-like antibodies. In FIG. 30A-30D, unusual features of VRC01 are shown structurally (far left panel), in terms of frequency as a histogram with other antibodies (second panel from left), and in the context of affinity and neutralization measurements after mutational alteration (right two panels). Affinity measurements were made by ELISA to the gp120 construct used in crystallization (93TH057), and neutralization measurements were made with a clade A HIV-1 strain Q842.d12. FIG. 30A shows N-linked glycosylation. The conserved tri-mannose core is shown with observed electron density, along with frequency and effect of removal on affinity. FIG. 30B shows an extra disulfide. Variable heavy domains naturally have two Cys, linked by a disulfide; VRC01 has an extra disulfide linking CDR H1 and H3 regions. This occurs rarely in antibodies, but its removal by mutation to Ser/Ala has little effect on affinity. FIG. 30C shows CDR L1 deletion. A two amino acid deletion in the CDR L1, prevents potential clashes with loop D of gp120. Such deletions are rarely observed; reversion to the longer loop may have a 10-100-fold effect on gp120 affinity. FIG. 30D shows the somatically altered contact surface. The far left panel shows the VRC01 light chain and heavy chain. Residues altered by affinity maturation are depicted with "balls" and contacts with HIV-1 gp120 are colored red. About half the contacts are altered during the maturation process. Analysis of human antibody-protein complexes in the protein-data bank shows this degree of contact surface alteration is rare; reversion of each of the contact site to genome has little effect though in aggregate the effect on affinity is larger.

FIGS. 31A-31B are a set of graphs showing somatic maturation and VRC01 affinity. Hypermutation of the variable domain during B cell maturation allows for the evolution of high affinity antibodies. With VRC01 this enhancement to affinity occurs principally through the alteration of non-contact residues, which appear to reform the genomic contact surface from affinity too low to measure to a tight (nM) interaction. FIG. 31A shows the effect of genomic reversions. The VH- and VK-derived regions of VRC01 were reverted to the sequences of their closest genomic precursors, expressed as immunoglobulins and tested for binding as VH- and VK-revertants (gHgL), as a VH-only revertant (gH), or as a VK-only revertant (gL) to the gp120 construct used in crystallization (93TH057) or to a stabilized HXBc2 core. These constructs were also tested for neutralization of a clade A HIV-1 strain Q842.d12. FIG. 31B shows maturation of VRC01 and correlation with binding and neutralization. Affinity and neutralization measurements for the 19 VRC01 mutants created during the structure-function analysis of VRC were analyzed in the context of their degree of affinity maturation. Significant correlations were observed, with extrapolation to VH- and VK-genomic revertants suggesting greatly reduced affinity for gp120.

FIG. 32 is a gp120 sequence alignment and residue-by-residue contacts with CD4 and VRC01. Both wild type clade B HXBc2 (SEQ ID NO: 44) and clade A/E 93TH057 core gp120 sequences (SEQ ID NO: 45) are displayed with HXBc2 numbering convention. The 93TH057 construct has shorter V1/V2 stem and has a new V3 stem. gp120 contacts are defined with the program PISA for the CD4 and VRC01 complexes, with open circles (○) denoting gp120 main-chain-only contacts, open circles with rays (¤) denoting gp120 side-chain-only contacts, and filled circles (●) denoting both main-chain and side-chain contacts. The major structure elements of gp120 that involved in ligand binding were underlined. Potential glycosylation sites on gp120 with signature sequence NXT/S are highlighted in cyan, however, not all sites are observed in the crystal structure. VRC01 has remarkably less interactions with the conformationally variable V1/V2 and β20/β21 regions and more interactions at the loop D and V5 areas.

Figure 33:
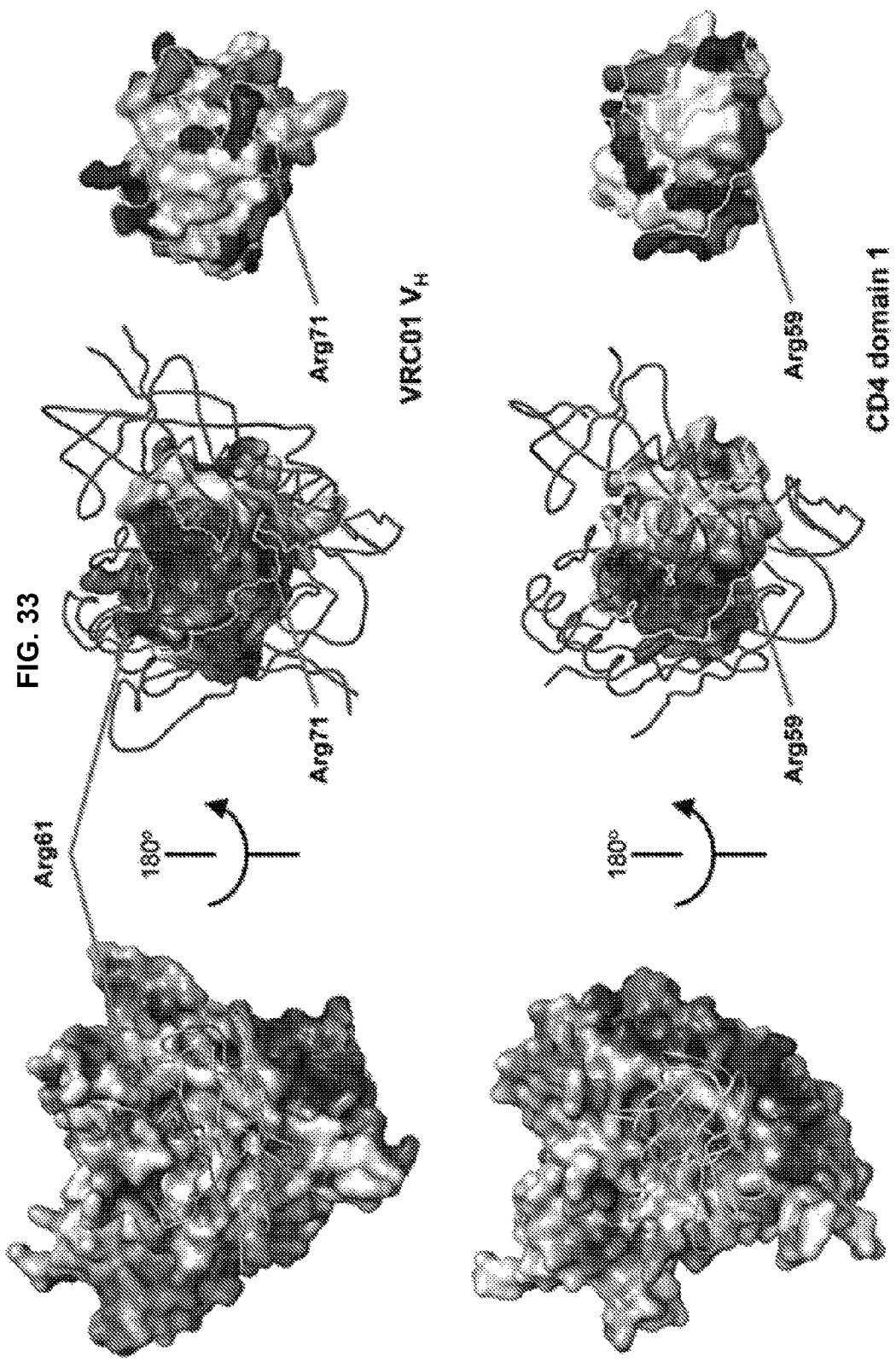

FIG. 33 is a set of electronic images showing electrostatic surfaces and maps of residues types of gp120. Electrostatic surfaces for the VRC01 and CD-bound gp120s are shown in the left panels with heavy chain variable domain (VH) of VRC01 (upper row) and domain 1 (D1) of CD4 (lower row). Both of VRC01 and CD4 bind to overall negatively charged surfaces on gp120. The flip sides of the complexes showing the electrostatic surfaces of VH and D1 are presented in the middle panels with gp120 in the foreground. The gp120 interfaces on VH of VRC01 and D1 of CD4 are mostly positively charged to complement the negatively charged gp120 surfaces. Certain residues, such as Arg71 in VRC01 and Arg59 in CD4, are conserved, the unique VRC01 Arg61 that penetrating the cavity formed by V5 and β24 is also shown. The electrostatic potential was calculated with APBS and visualized with Pymol.

Figure 34:
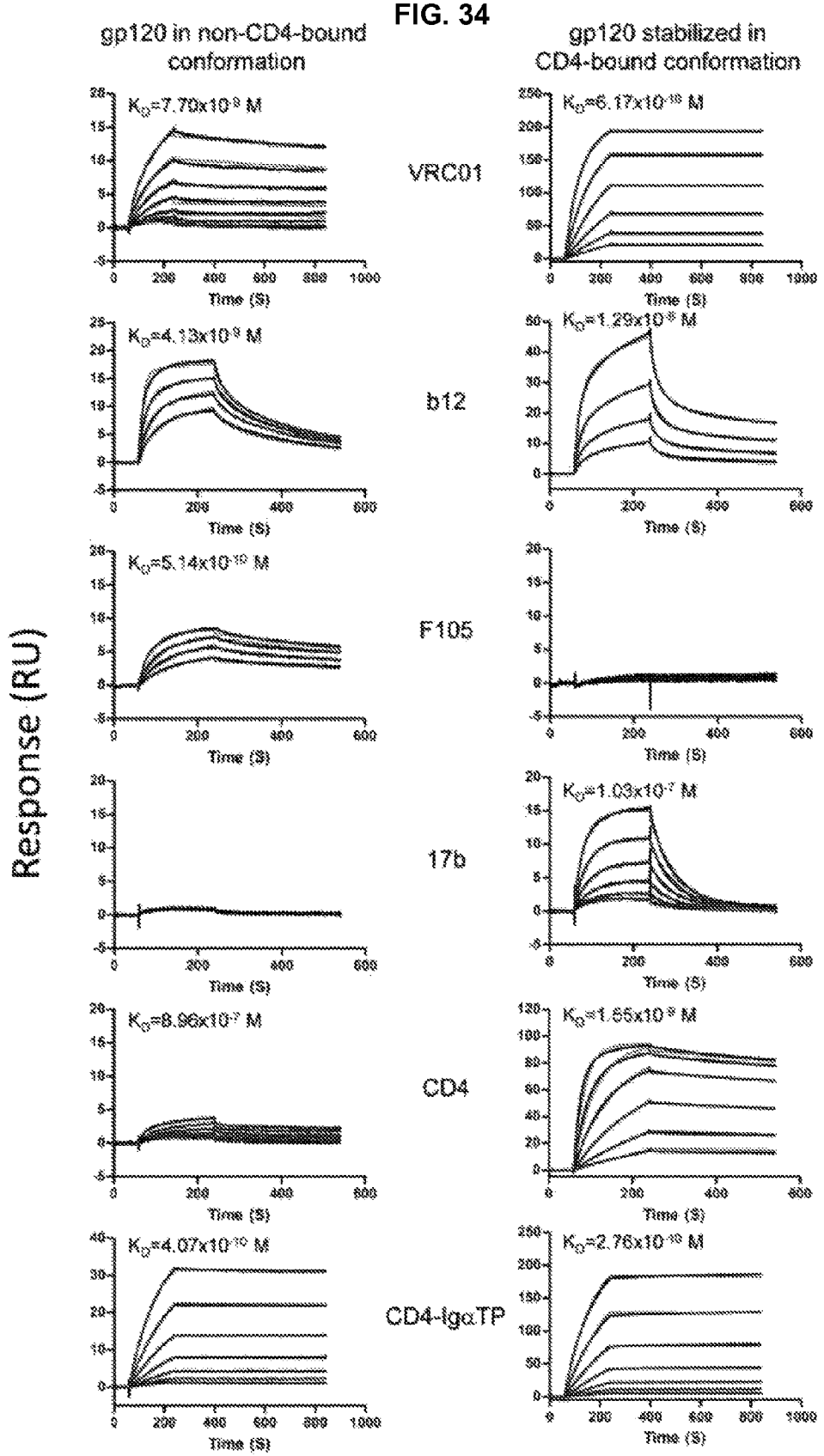

FIG. 34 is a set of graphs showing the binding of VRC01 to gp120 stabilized in CD4-bound and non-CD4-bound conformations. Both gp120 in non-CD4-bound conformation (YU2

Δβ4) and gp120 stabilized in CD4-bound conformation (HXBc2 core Ds12F123) were immobilized on a CM-5 chip. Fabs of CD4-binding site antibodies VRC01, b12 and F105 and CD4-induced antibody 17b, two domain CD4 and CD4-IgαTP at various concentrations were injected over the chip channels.

FIGS. 35A and 35B are a set of electronic images and a bar graph showing a comparison of coverage of the site of vulnerability by different CD4-binding site antibodies. The site of vulnerability is the contact site for receptor CD4 on the outer domain of gp120. CD4-binding-site-directed antibodies target this general area, however, most of them do not neutralize potently. FIG. 35A shows that when the site of vulnerability is superimposed over the antibody epitopes on gp120 surfaces, the degrees of overlapping differ. VRC01 hits the "bull's-eye" while b12, b13 and F105 miss portions of the target with epitope straying away to other conformationally variable areas on gp120. FIG. 35B shows that when coverage of the site of vulnerability by epitopes of CD4-binding-site-directed antibodies were compared, VRC01 achieves almost full coverage (98%) while others, such as b13, F105 and b12, manage to get 50% to 83% overlapping coverage with CD4.

Figure 36A:
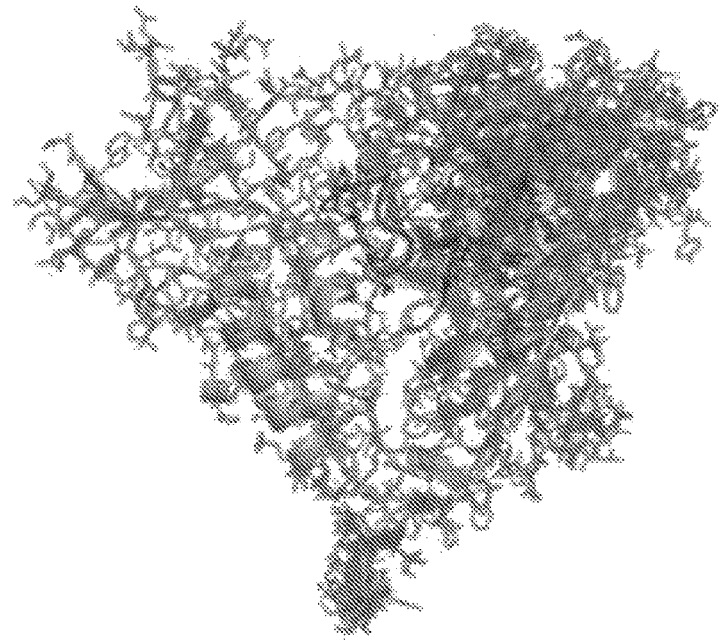
Figure 36B:
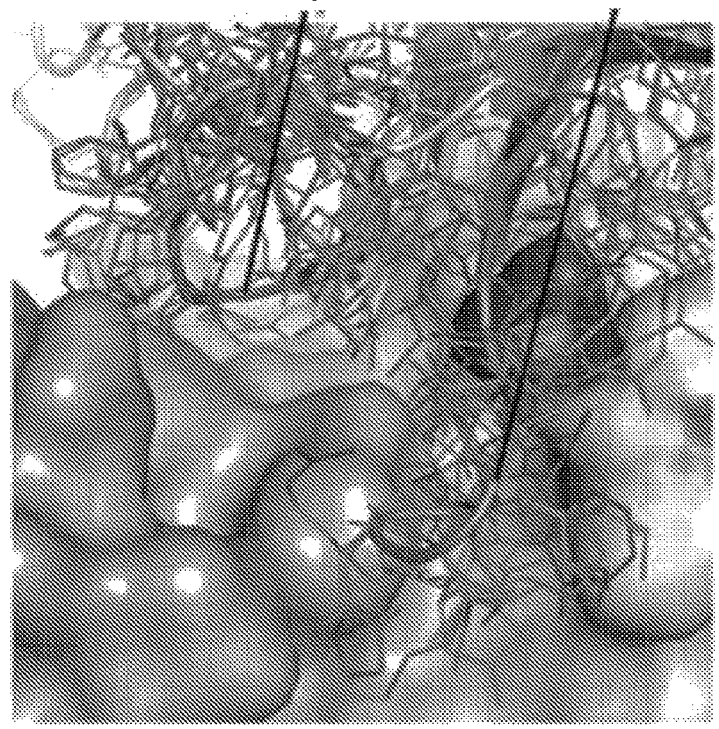
Figure 36C:
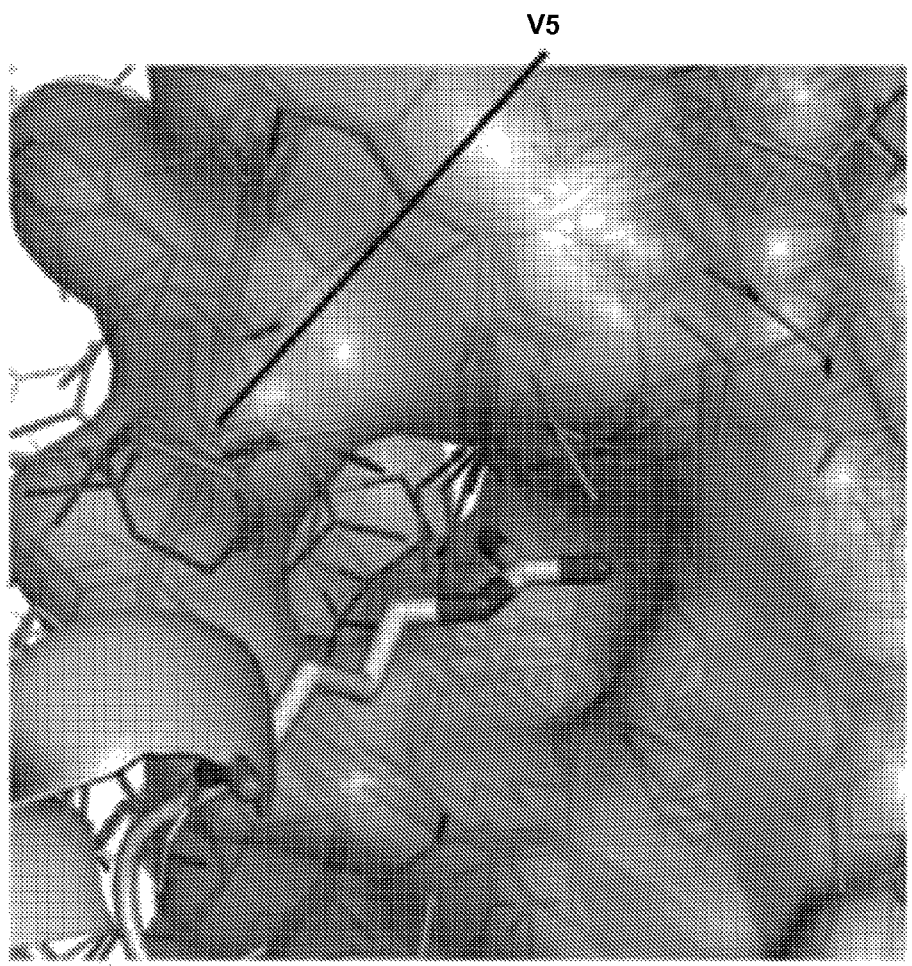
Figure 36D:
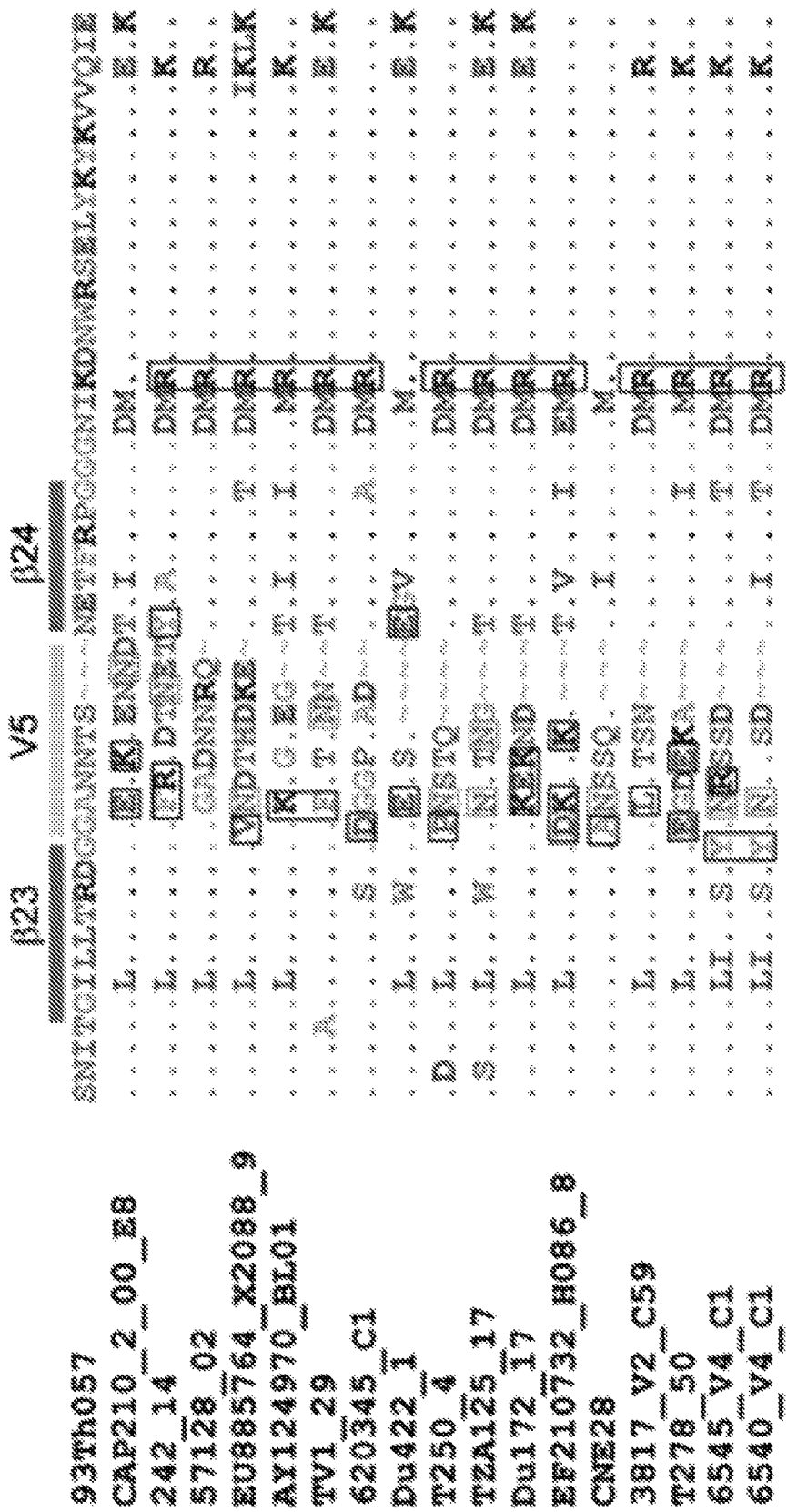

FIGS. 36A-36D are a set of electronic images and a sequence alignment showing the mechanism of natural resistance to VRC01. FIG. 36A shows a sequence threading of the 17 HIV-1 isolates that resist neutralization by VRC01. Spots that are closer than 2.5 Å to VRC01 are dark. These spots are clustered at the loop D and V5 region on HIV-1gp120. FIG. 36B shows a close-up of threaded, resistant isolates along with the molecular surface of VRC01. FIG. 36C shows VRC01 heavy chain Arg61 penetrating the gp120 cavity formed by V5 and β24. Some resistant isolates have bulky residues pointing into the cavity which interfere with Arg61VRC01 without affecting CD4 binding. FIG. 36D shows a sequence alignment of VRC01-resistant isolates at the V5 region (SEQ ID NO: 46). Black boxes highlight bulky residues that may interfere with binding of VRC01 and are different from the 93TH057 sequence. Different N-linked glycosylation patterns are also marked.

FIG. 37 is an electronic image showing the conformational variation of gp120 loop V5. Side-by-side comparison of conformation variation at the HIV-1 gp120 variable loop 5 region indicates that the four gp120 components (left panel, chains G, A, D and I) of the VRC01:gp120 complexes in the crystallographic asymmetric unit vary only at the tip of V5 loop and conformation of the V5 base is less flexible due to increased contacts by VRC01. In contrast, variation of V5 conformations in other gp120 complexes (right panel) with CD4 and CD4-binding site antibodies, F105, b12 and b13, spans over the whole range of V5 loop.

Figures 38A, 38B:
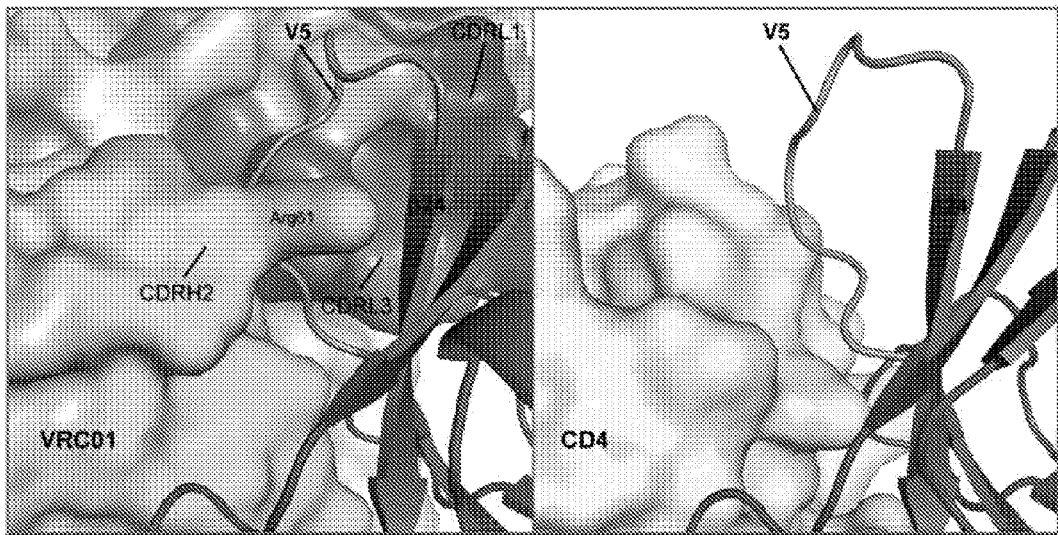
Figures 38C, 38D:
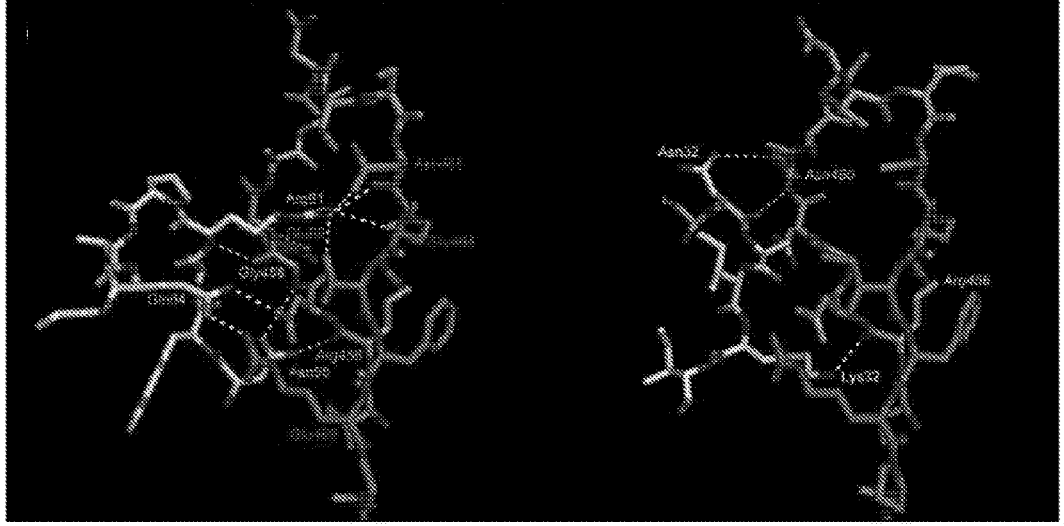

FIGS. 38A-38D are electronic images showing that VRC01 recognition of V5 and β24 of gp120 is different from that of CD4. FIGS. 38A and 38B illustrate that the V5 loop is wedged in the gap formed by the heavy and light chains of VRC01, meanwhile, Arg61 in the CDRH2 penetrates into the cavity formed by gp120 V5 and β24, locking V5 into a less flexible conformation. In contrast, CD4 only interacts with the "front side" of V5. FIGS. 38C and 38D illustrates that VRC01 engages extensive interactions with V5 and β24 with 10 hydrogen bonds and a salt bridge from both CDR H2 and CDR L3. While heavy chain Asn68, Gln64 and light chain Glu96 grab the front side of V5, heavy chain Arg61 goes behind the V5 and provides 4 hydrogen bonds to residues on β24. CD4, however, only has 3 hydrogen bonds to 2 V5 residues. It is worth to note that VRC01 only interacts with residues at the base of V5 loop and avoids the loop tip which has higher degree of sequence variation. The VRC01 CDRs are shown. Selected gp120 residues are labeled in italic.

FIG. 39 is a set of electronic images showing the key interface regions of the gp120:VRC01 complex. gp120-interacting CDRs of VRC01 are projected over the gp120 surface (left panel). Both heavy and light chains are involved in binding of gp120, mainly to the conformationally invariant outer domain. The CDR H2 spans over the CD4-binding loop and the V5/β24, with Arg61 penetrating the V5/β24 cavity (right panel). Arg71 in the framework 3 forms salt bridges with a conserved Asp368 in the CD4-binding loop of gp120. The light chain of CDRL1 and CDRL3 provide interactions to V5, loop D as well as the Loop D attached N-acetyl-glucosamine of a N-linked glycan.

FIG. 40 is an alignment of the VRC01 sequence, gp120 contacting-sites and extent of affinity maturation. The sequence of VRC01 (SEQ ID NO: 1 and SEQ ID NO: 2) is shown along with nearest VH- and VK/λ-genomic precursors for heavy (SEQ ID NO: 41) and light chain (SEQ ID 42), respectively. Affinity maturation changes are indicated in green, with residues involved in interaction with HIV-1 gp120 highlighted by "●", if involved in both main- and side-chain interactions, by "○" if main chain-only, and by "□" if side chain-only. "♣" marks a site of N-linked glycosylation, "▲" for Cysteine residues involved in a noncanonical disulfide, and "Δ" if the residue has been deleted during affinity maturation.

Figure 41:
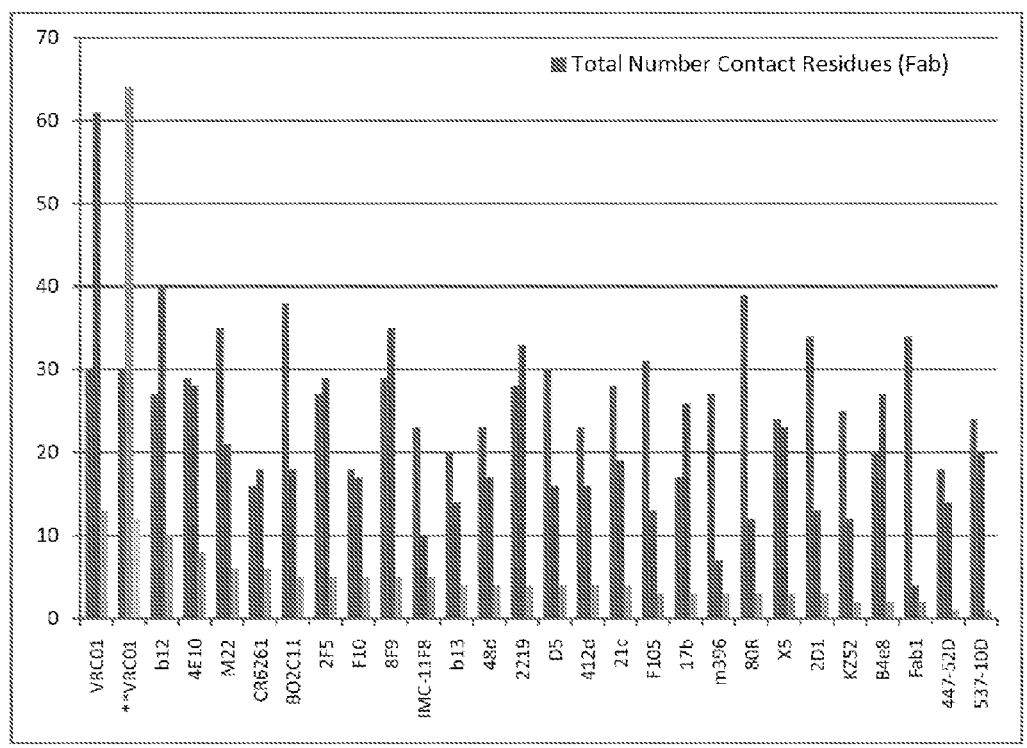

FIG. 41 is a bar graph showing the contact, V-gene mutated, and mutated contact residues for the set of 26 antibodies and VRC01. Any antibody residue in contact with the antigen in the complex is included towards the total number of contact residues. The number of mutations from germline for the Vh and Vl/Vk, as well as the number of mutated contact residues are shown. The number of mutations excludes insertions and deletions. Germline alignment was performed using the amino acid sequences for the antibody heavy and light chains. For comparison, also shown is the number of mutated residues (total and only contact residues) when germline alignment is performed for the **VRC01 nucleotide sequence.

Figure 42:
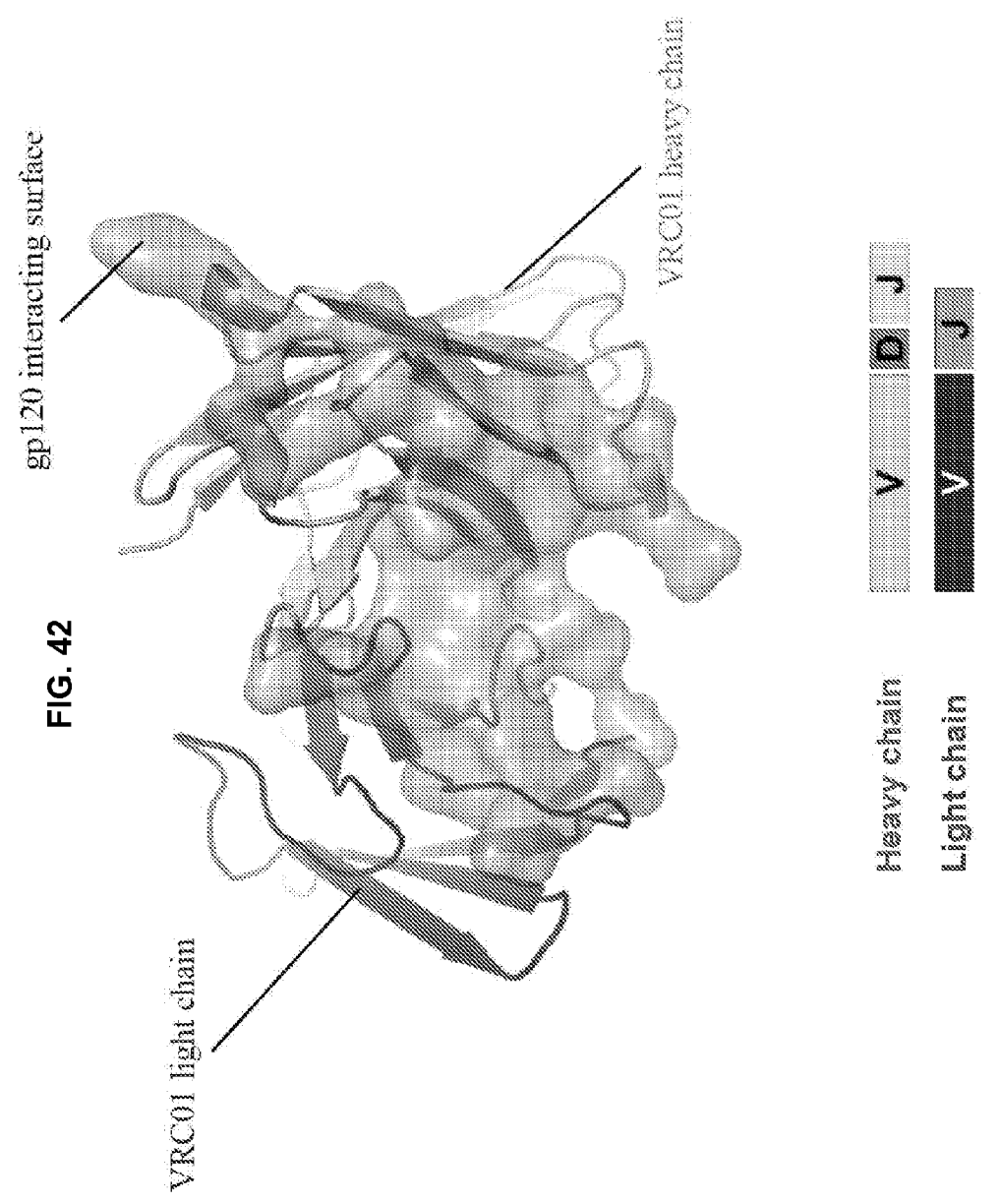

FIG. 42 is an electronic image showing of the contributions of VRC01 VH-D-J and VK-J fragments to the binding of HIV-1 gp120. The variable domains of VRC01 are shown in cartoon diagram and the gp120 binding areas are masked with a surface.

FIG. 43 is the alignment of VRC01 Vh (SEQ ID NO: 1) to the ten closest germline genes. Results were obtained from IgBLAST using the VRC01 Vh nucleotide sequence. Residue identities are shown as dots. The nucleotide identity fraction for each of the ten germline genes, as reported by IgBLAST, is also shown.

FIG. 44 is the alignment of VRC01 Vk (SEQ ID NO: 2) to the ten closest germline genes. Results were obtained from IgBLAST using the VRC01 Vk nucleotide sequence up to amino acid residue Q90; since IGKV3-NL1*01 is 'not localized', IGKV3-11*01 was selected as a top match for the Vk germline. When comparing to IGKV3-11*01 using nucleotide sequences, the two-residue deletion in VRC01 Vk aligns to two S residues and involves a neighboring S→Y mutation. Residue identities are shown as dots. The nucleotide identity fraction for each of the ten germline genes, as reported by IgBLAST, is also shown.

FIGS. 45A-45C is a set of graphs showing the results of a sequence comparison of VRC01, VRC02 and VRC03 to a collection of gp140-binding antibodies. FIG. 45A is a VH and Vk repertoire analysis for a collection of gp140-binding antibodies and VRC01, 02 and 03. The pie charts display the distribution of V gene usage among the collection of unique antibodies. VRC01, 02, 03 genes are indicated with red arrows. FIG. 45B shows a CDR amino acid length of the collection of antibodies compared to VRC01, 02 and 03 indicated with a red arrow. CDR3 lengths were determined according to NCBI IgBlast nomenclature with the CDR3 region starting after the CTR and CVR amino acids for VRC01, 02 and 03, respectively. FIG. 45C shows the number of nucleotide mutations in the V genes of the antibody collection compared to VRC01, 02 and 03.

FIG. 46 is a set of graphs showing the correlations between the number of affinity matured residues in VH and Vk and SPR determined dissociation constants, ELISA (EC50) binding, and neutralization (IC50) data for a set of VRC01 variants. VRC01 variants were made to revert interface residues to their corresponding VH- and Vk germline-encoded residues in a series of single-, 4-, 7- or 12-residue mutations.

Figures 48, 49:
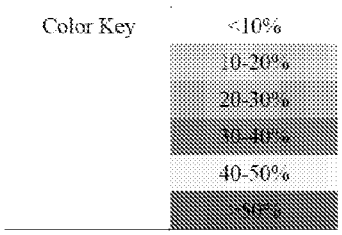

FIG. 47 is Table S1.
FIG. 48 is Table S2.
FIG. 49 is Table S3.
FIG. 50 is Table S4.
FIG. 51 is Table S5.
FIG. 52 is Table S6.
FIG. 53 is Table S7.
FIG. 54 is Table S8.
FIG. 55 is Table S9.
FIG. 56 is Table S10a.
FIG. 57 is Table S10b.
FIG. 58 is Table S11.
FIG. 59 is Table S12.
FIG. 60 is Table S13.
FIG. 61 is Table S14.

Figure 62C:
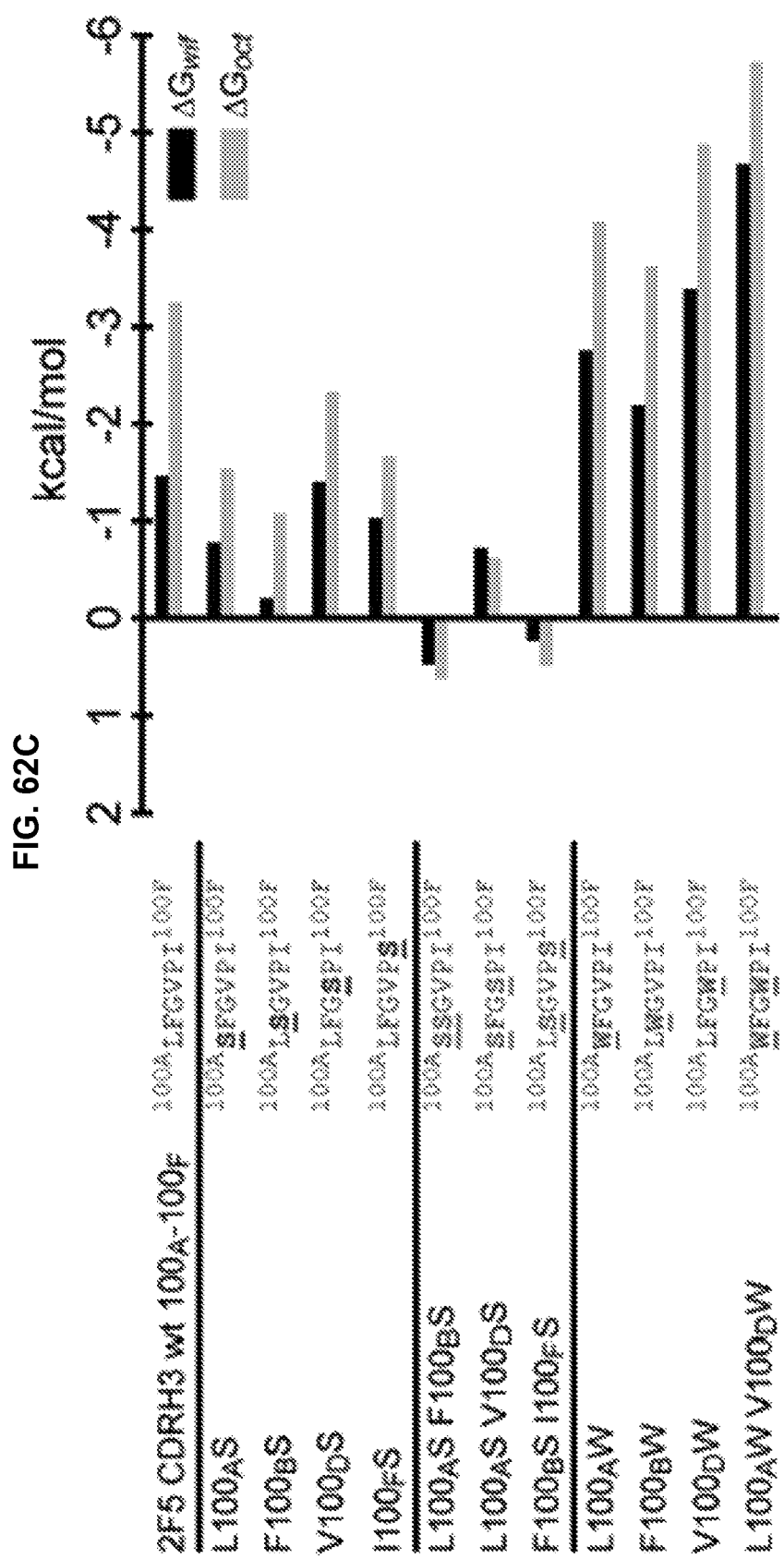

FIGS. 62A-62C is a set of electronic images a sequence alignment and a bar graph showing F5 CDR H3 loop mutagenesis (SEQ ID NOs: 47-58). FIG. 62A illustrates the structure of 2F5 Fab in complex with a gp41 peptide. The 2F5 CDR H3 contacts gp41 only at its base, while the tip extends away from the peptide.

FIG. 62B is a close-up view of the 2F5 CDR H3 loop. FIG. 62C shows mutations introduced into the tip of the 2F5 CDR H3 (100A to 100F) along with a plot of the Wimley-White predicted free energies of transfer to a lipid bilayer interface or to octanol for each of the mutations.

FIG. 63 is Table 1.

FIG. 64 is a set of graphs showing the neutralization of HxB2 by CDR H3 mutants of antibody 2F5. Top, neutralization profiles of 2F5 variants with single mutations to serine. Single serine substitutions resulted in a 15- to 500-fold reduction in neutralization potency. Middle, neutralization profiles of double mutations to serine. Double serine substitutions completely abrogated 2F5-mediated neutralization. Bottom, neutralization profiles of 2F5 variants with mutations to tryptophan. Tryptophan substitutions were either commensurate with or more potent than wild-type 2F5. Neutralization curves for wild-type 2F5 IgG are colored black and are shown in all three panels. 1D4, mouse anti rhodopsin antibody used as a negative control.

Figure 65A:
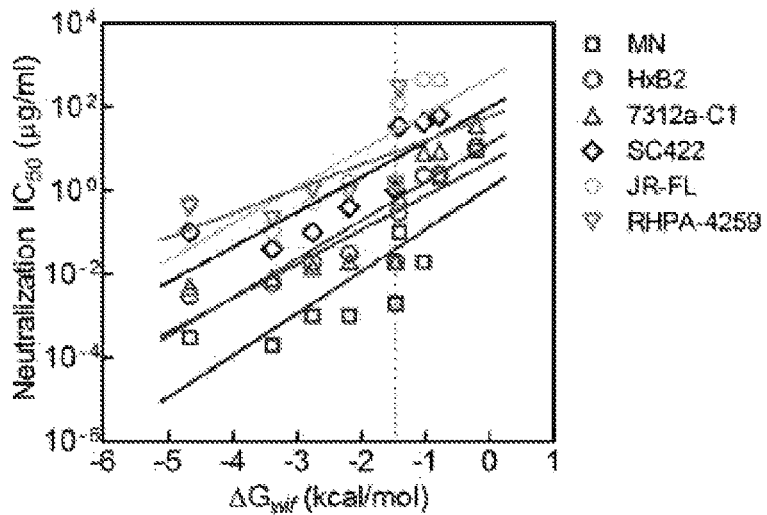
Figure 65B:
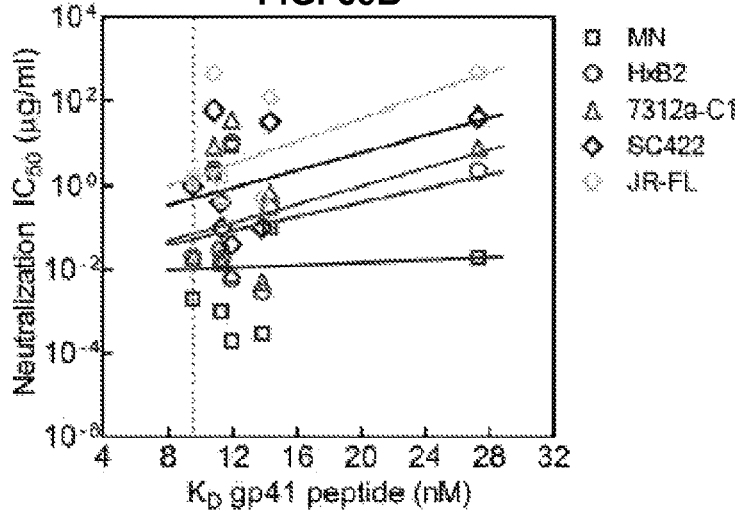
Figure 65C:
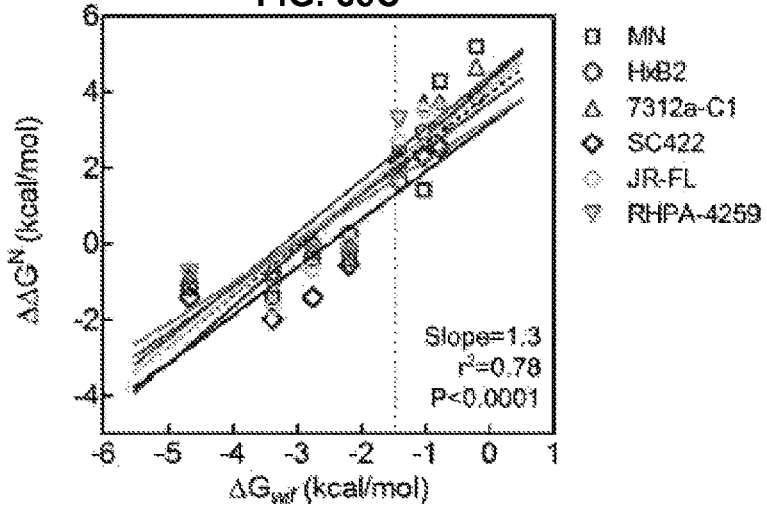

FIGS. 65A-65C are a set of graphs showing the relationship between 2F5-mediated HIV-1 neutralization and the hydrophobicity of its CDR H3 loop. FIG. 65A shows 2F5 variant neutralization IC50s plotted against the calculated $\Delta G_{wif}$ of the 2F5 CDR H3 loop for each virus strain tested. Linear regressions were fit to each individual group, and no significant differences were observed in the slopes of each of the curves. The resulting P values of the correlations were statistically significant (P<0.02) for all strains tested, with the exception of RHPA-4259. FIG. 65B shows 2F5 variant neutralization IC50s plotted against affinity to gp41MPER peptide, with linear fits applied to each group. No statistically significant associations were observed in this case, and the regressions appeared largely driven by the KD of 2F5 variant I100FS to gp41, likely because of minor contacts made by this residue with gp41. FIG. 65 C shows plots of relative free energies of neutralization ($\Delta\Delta G^N$) versus calculated $\Delta G_{wif}$ values, along with individual solid lines) and shared (dashed black line and displayed statistics) linear fits for all strains tested. HIV strains are represented as symbols and lines. The dashed vertical lines define the $\Delta G_{wif}$ value of the wild-type 2F5 CDR H3 tip or the KD of wild-type 2F5 to gp41 peptide.

FIG. 66 is Table 2.

Figure 5B:
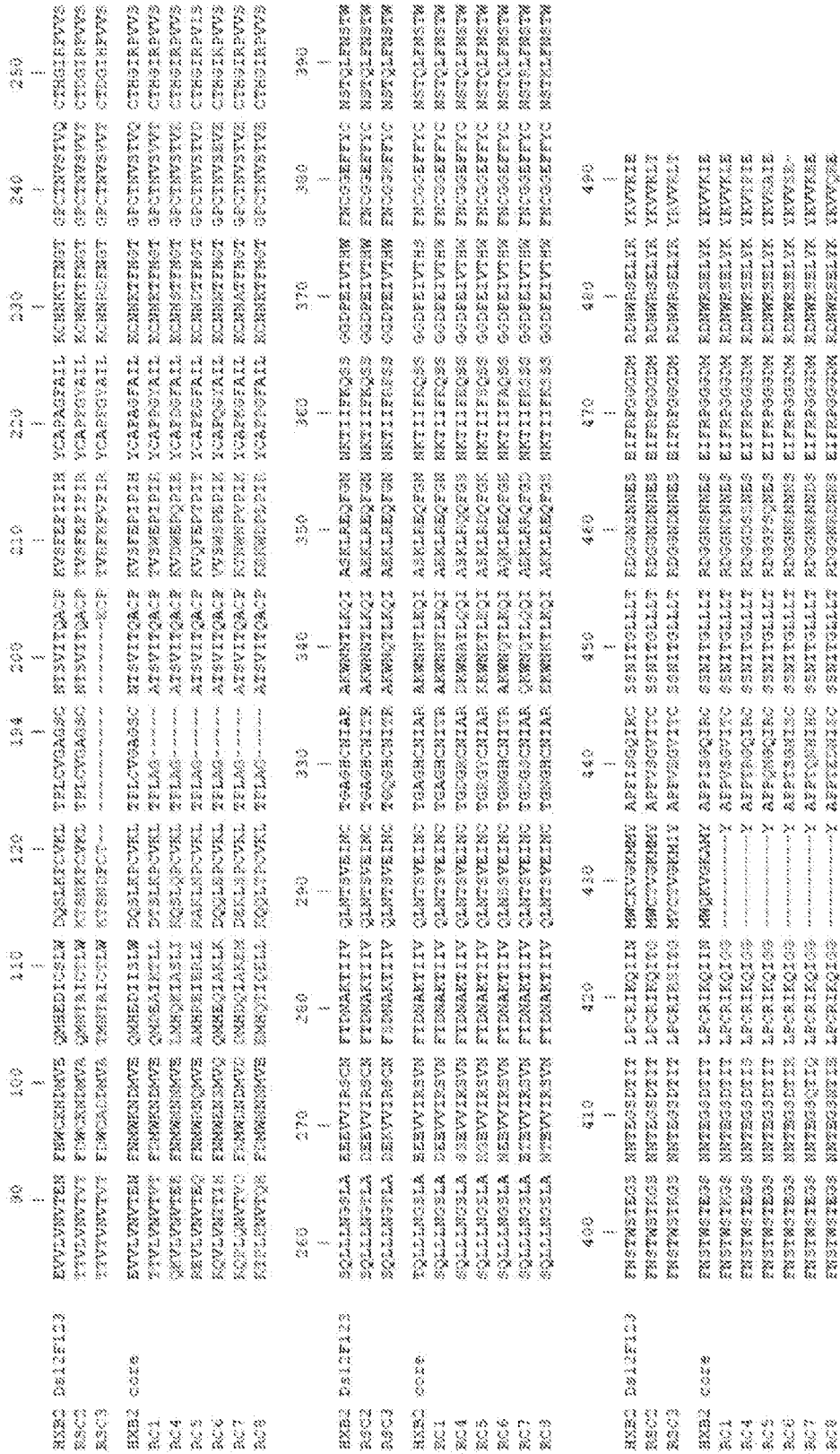
FIG. 5B is a protein sequence alignment of the resurfaced proteins and the HIV-1 HXB2 core or stabilized core (Ds12F123), which provided the framework for the resurfaced protein designs. Residue positions are marked according to the HXB2 sequence. Highlighted are amino acid substitutions made in the resurfaced proteins in comparison to the original HXB2 core or stabilized core sequences. Gaps are indicated as "-".
Figure 8:
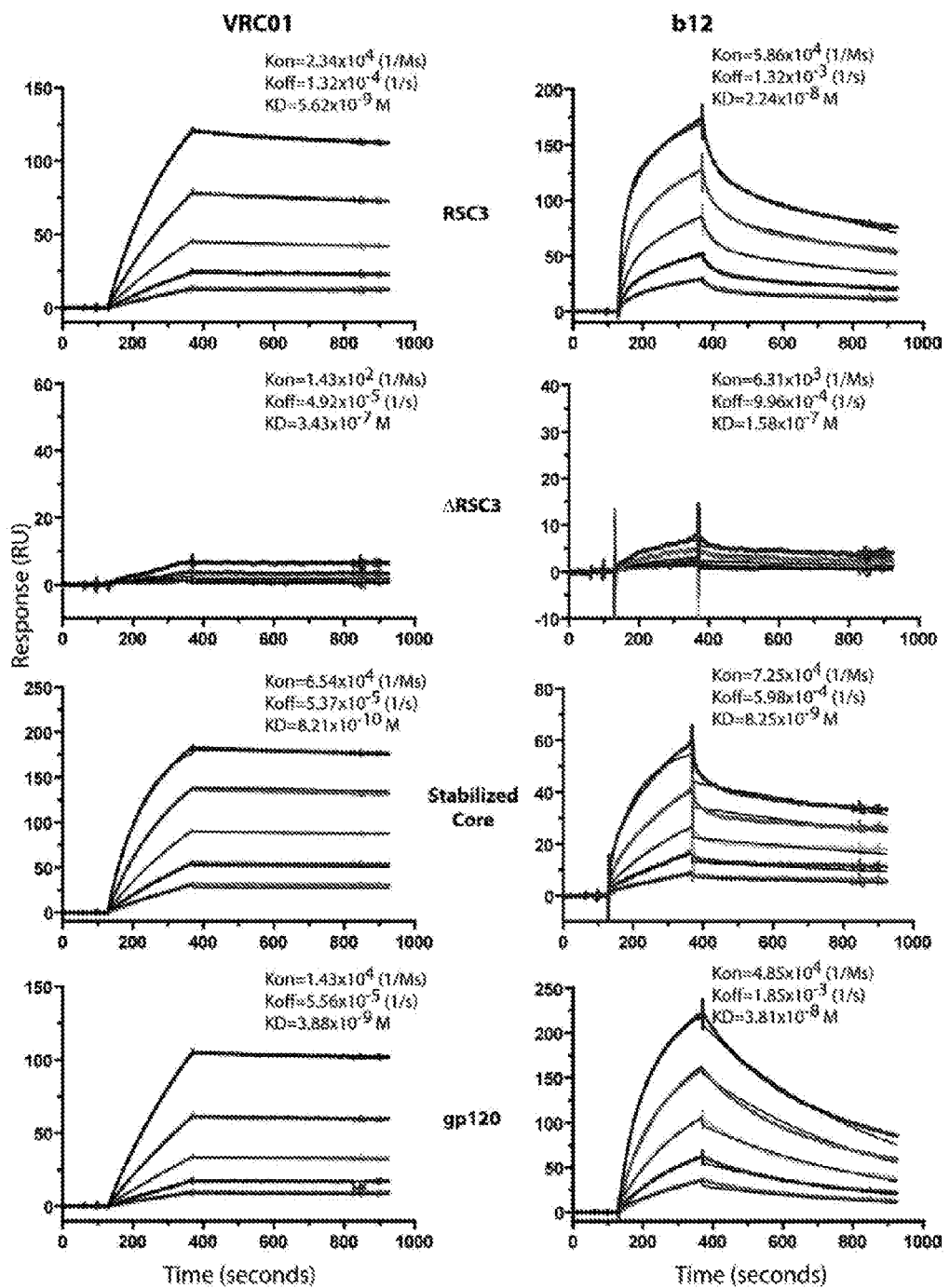
Figure 9:
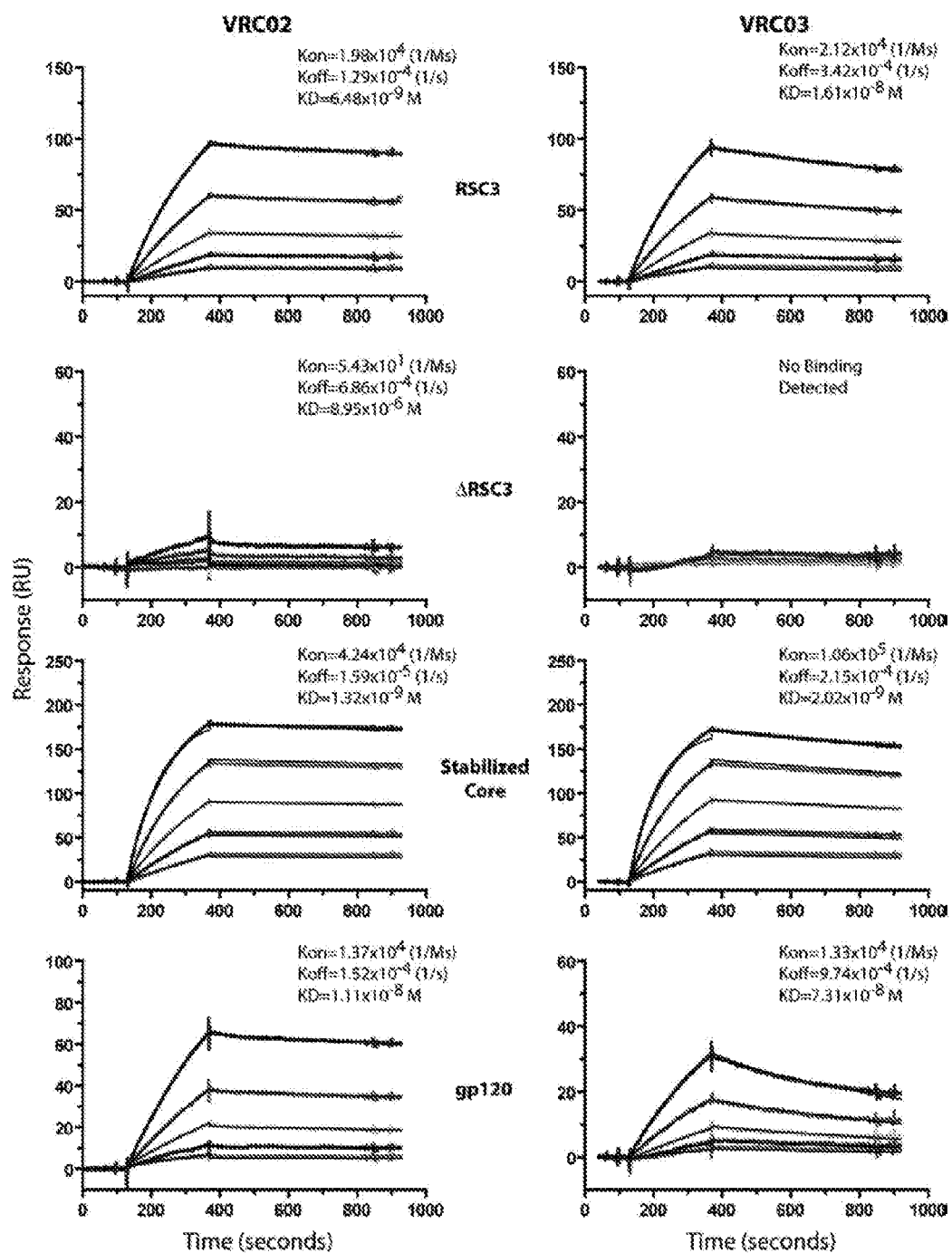
Figure 67A:
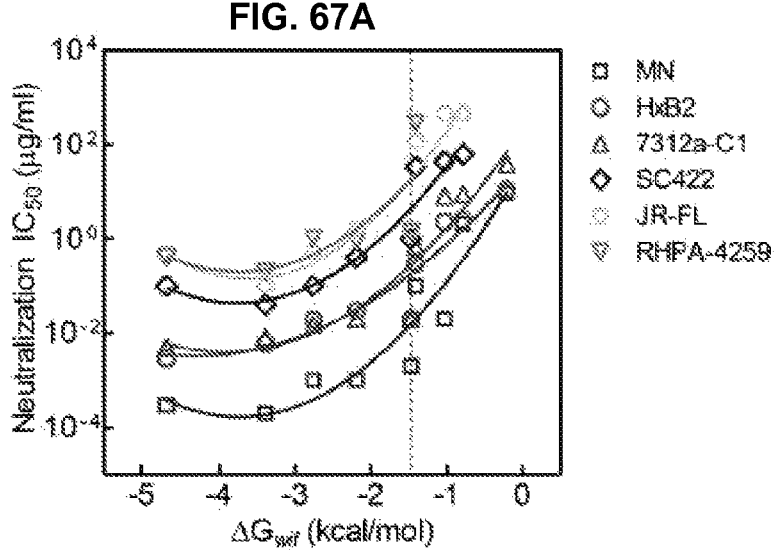
Figure 67B:
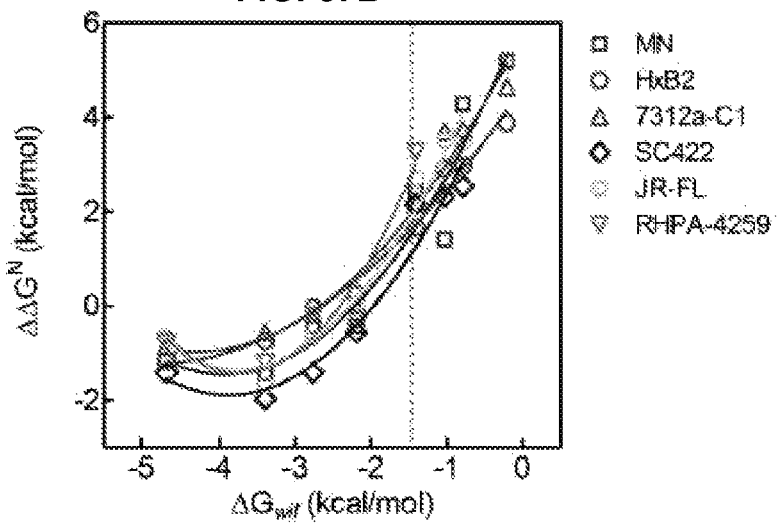
Figure 67C:
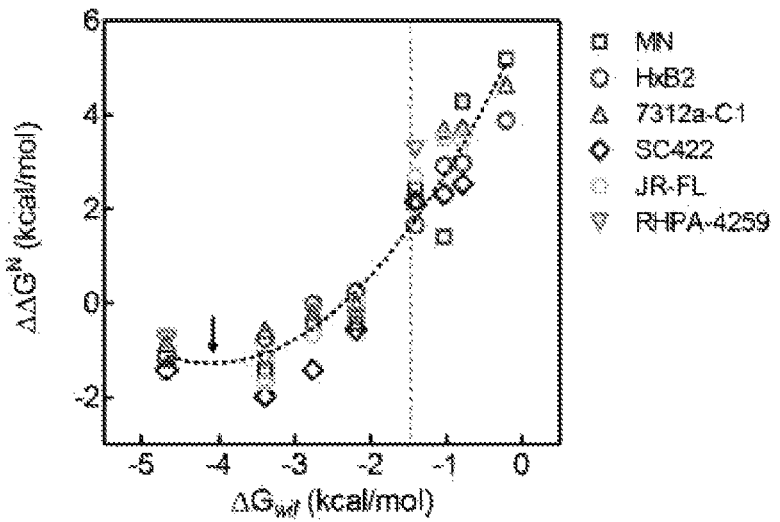

FIGS. 67A-67C are a depiction of the threshold for effects of increased 2F5 CDR H3 loop hydrophobicity. To account for the observed leveling off of the effects of increased 2F5 CDR H3 loop hydrophobicity, quadratic fits were applied to the data shown in FIG. 66. FIG. 67A, 2F5 variant neutralization IC50s plotted against the calculated $\Delta G_{wif}$ of the 2F5 CDR H3 loop for each virus strain tested. Individual curves were fit to each group using a quadratic regression model, which revealed no significant differences in their slopes or quadratic terms. FIG. 67B, plot of relative free energies of neutralization ($\Delta\Delta G^N$) versus calculated $\Delta G_{wif}$. As in panel A, individual curves were fit to each group using a quadratic regression model, which revealed no significant differences in their slopes or quadratic terms. FIG. 67C, the quadratic models were refit to the data using common estimates of the slopes and quadratic terms and plotted as a shared quadratic regression for all strains tested (dashed black line). A minimum of the $\Delta\Delta G^N$ was observed to occur at a $\Delta G_{wif}$ of −4.08 kcal/mol (arrow), representing the maximal effect on neutralization beyond which increased hydrophobicity of the CDR H3 loop had detrimental effects on 2F5-mediated neutralization. HIV strains are represented as symbols and lines. The dashed vertical lines (gray) define the $\Delta G_{wif}$ value of the wild-type 2F5 CDR H3 tip.

Figure 68:
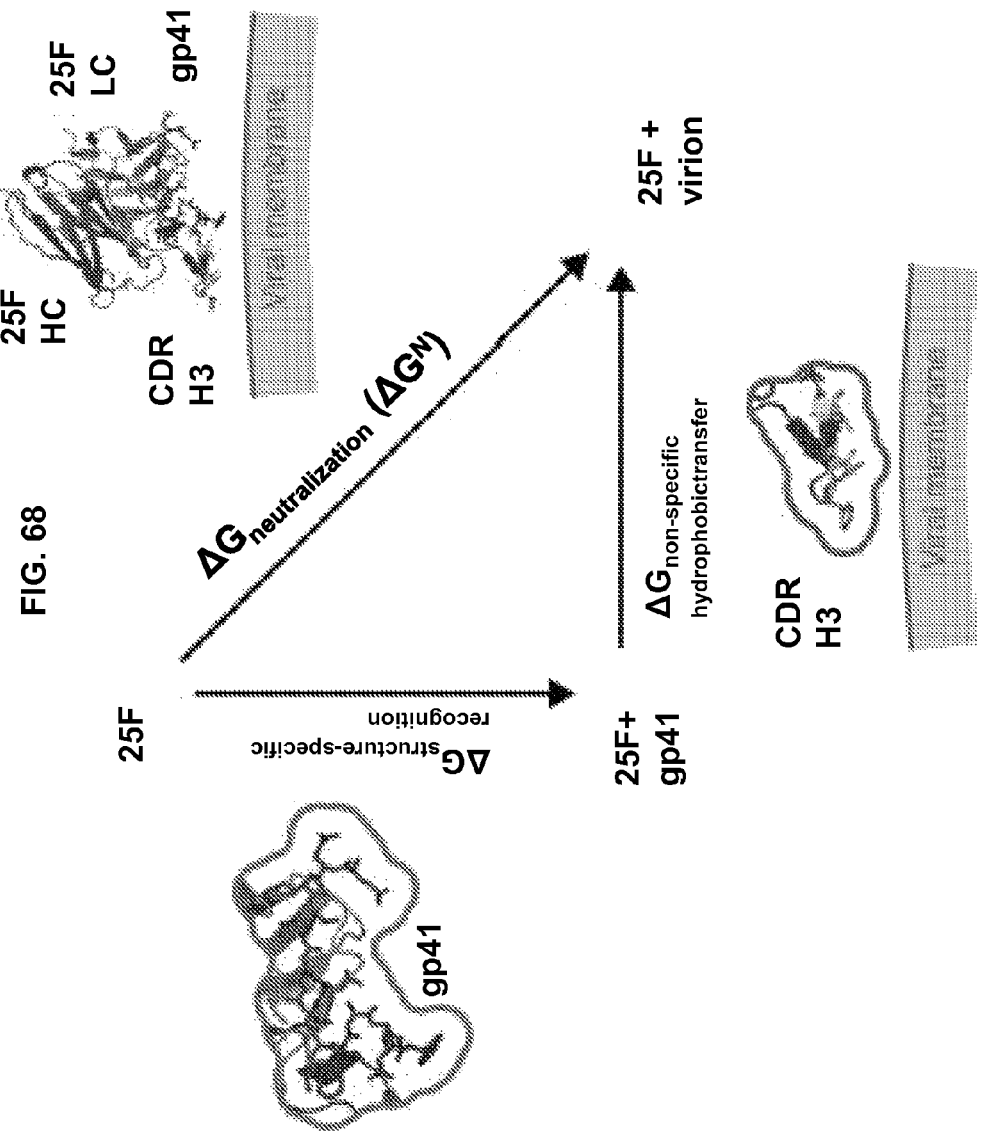

FIG. 68 is schematic representation of the two-component mechanism of 2F5-mediated neutralization of HIV-1. The free energy of 2F5-mediated neutralization of HIV-1, $\Delta G^N$ (diagonal), can be expressed as the sum of the free energy of its structure-specific recognition of its gp41MPER epitope (vertical component) combined with the free energy of non-specific interactions mediated by the hydrophobic tip of its CDR H3 loop (horizontal component). Structural representations of each component are shown.

FIG. 69 is Table s1.
FIG. 70 is Table s2.
FIG. 71 is Table s3.

Figure 72:
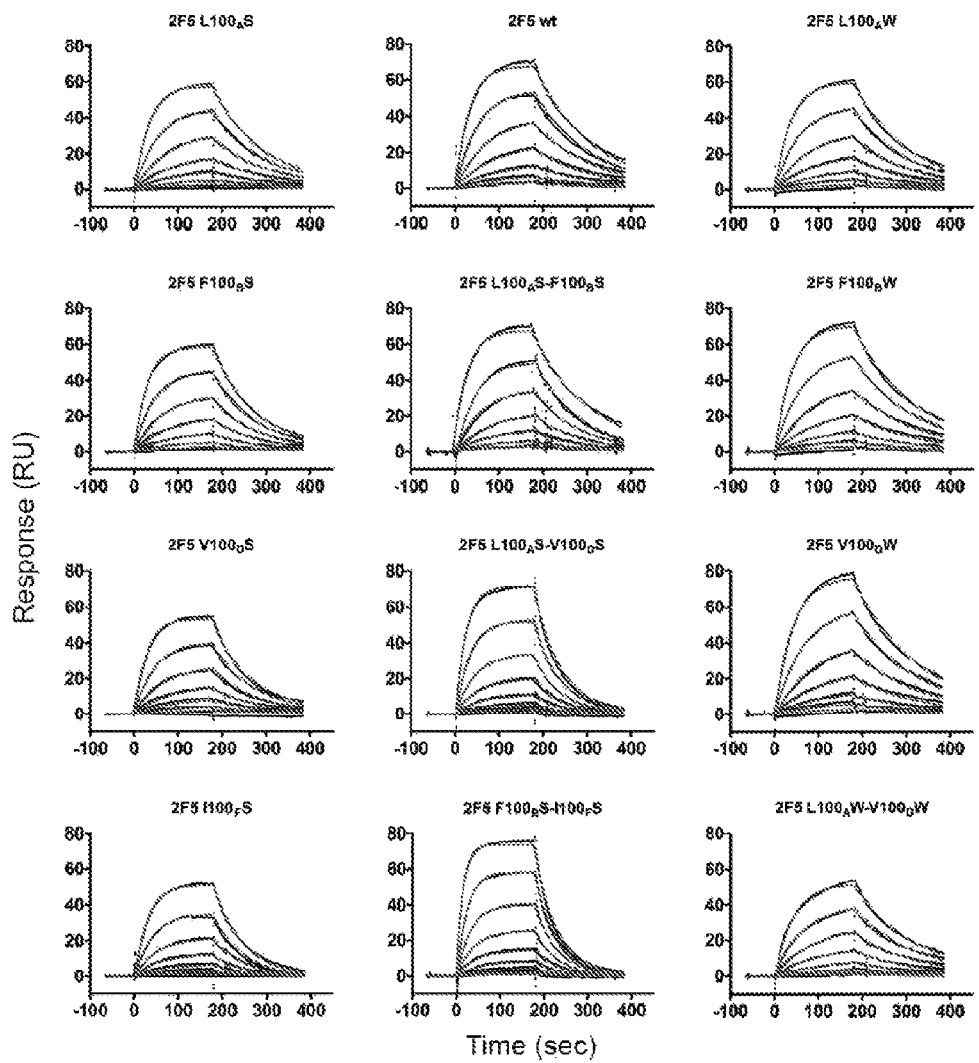

FIG. 72 is a set of graphs showing the results of surface plasmon resonance binding profiles of 2F5 variants to gp41 peptide. Shown are representative biacore binding profiles of gp41-MPER-C9 peptide to wild-type and mutant 2F5 IgG's (black), overlaid with fits of the data. In all cases, IgGs were directly coupled to CM5 chips, and the peptide was used as analyte. Plotted analyte concentratations are 2-fold serial dilutions ranging from 31 nM to 0.49 nM, except for 2F5 variant L100AS-F100BS, which ranged from 15 nM to 0.49 nM, and variants L100ASV100DS and F100BS-1100FS, which ranged from 125 nM to 0.49 nM. In all cases, nanomolar binding affinity to gp41 peptide was maintained.

FIGS. 73A-73D is a set of graphs of the relationship between HIV-1 neutralization and $\Delta G_{oct}$ hydrophobicity of 2F5 CDR H3 P<0.0001 variants. FIG. 73A, 2F5-variant neutralization IC50s plotted against calculated $\Delta G_{oct}$ of the 2F5 CDR H3 loop, for each virus strain tested. Linear regressions were fit to each individual group, and no significant differences were observed in their slopes. The resulting P-values of the correlations were all statistically significant (P<0.05), with the exception of RHPA-4259. FIG. 73B shows that quadratic regressions fit to the same data as in FIG. 73A, reveal no significant differences in the slopes or quadratic terms. Plots of relative free energies of neutralization ($\Delta\Delta G^N$) versus calculated $\Delta G_{oct}$, were fit with linear (FIG. 73C) and quadratic regression models (FIG. 73D), as shown. Shared regressions across all strains in FIG. 73C and FIG. 73D are represented as dashed black lines. A dashed vertical line defines the $\Delta G_{oct}$ properties of the wild-type 2F5 CDR H3 tip.

FIG. 74A is a schematic diagram and the sequence of VRC01 ImmunoAdhesin HL (SEQ ID NO: 66).

FIG. 74B is a schematic diagram and the sequence of VRC01 ImmunoAdhesin LH (SEQ ID NO: 66).

FIGS. 75A-75E is a series of schematic diagrams for VRC8551, VRC8552, VRC9709, VRC9710, VRC9711, VRC9712, VRC9713, VRC9714, VRC9715, VRC9716, VRC9717, VRC9712, VRC9713 and VRC9174.

FIG. 76 is a table and an electronic image of a protein gel showing the expression of chimeras of VRC01 and VRC03.

Figure 77:
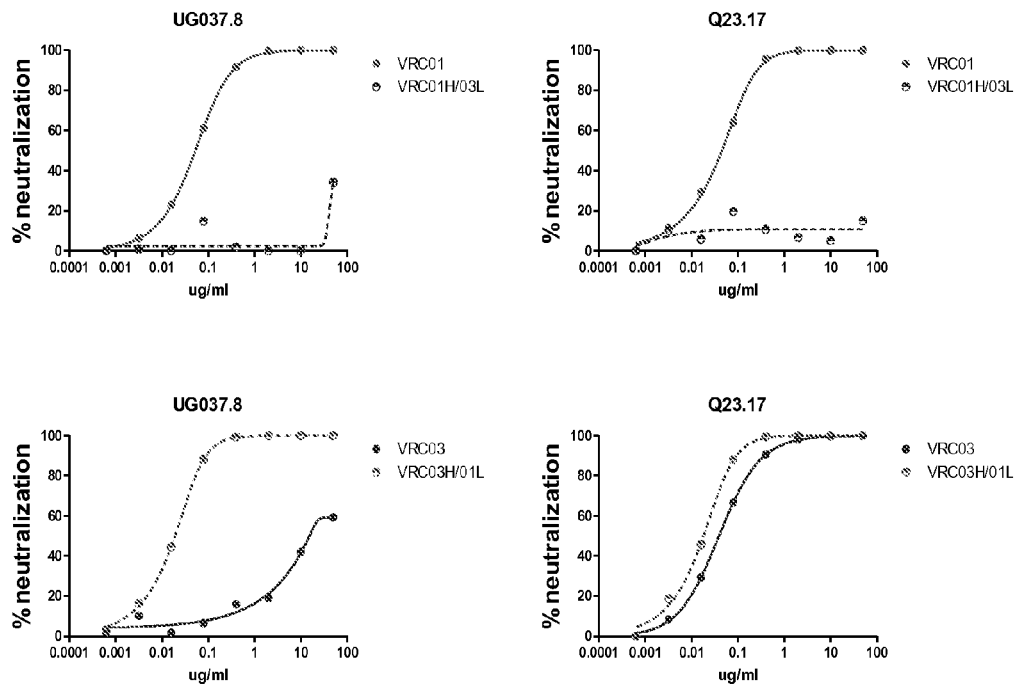

FIG. 77 is a set of graphs showing exemplary neutralization data for clade A HIV viruses obtained from VRC01 and VRC03 chimeric antibodies.

Figure 78:
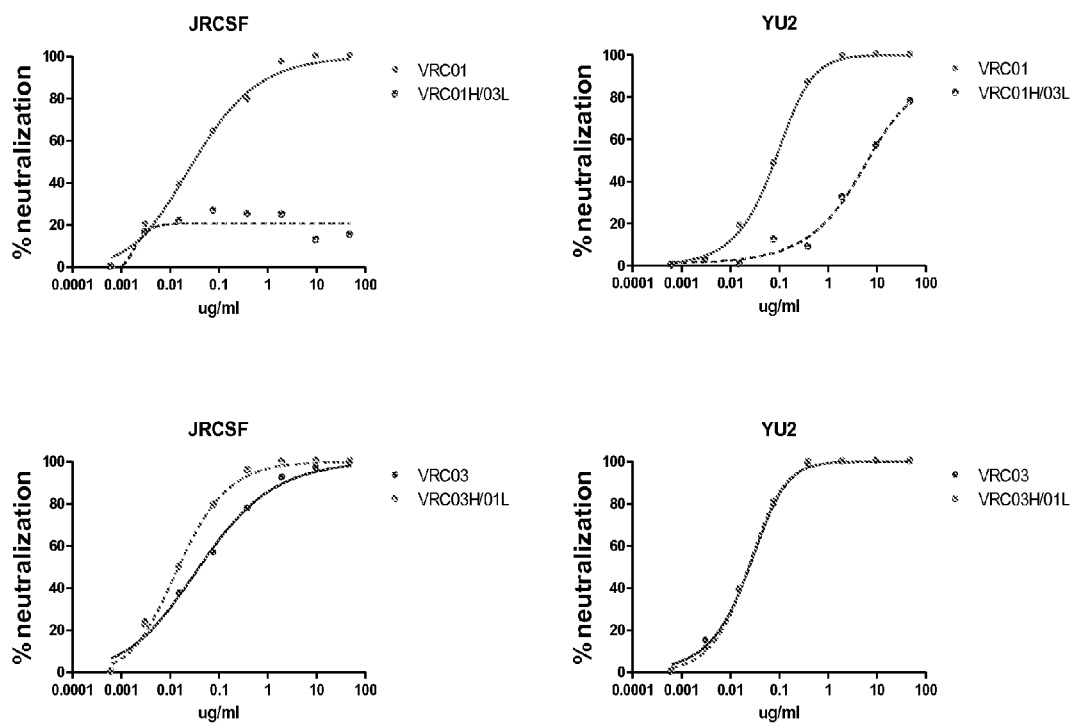

FIG. 78 is a set of graphs showing exemplary neutralization data for clade B HIV viruses obtained from VRC01 and VRC03 chimeric antibodies.

Figure 79:
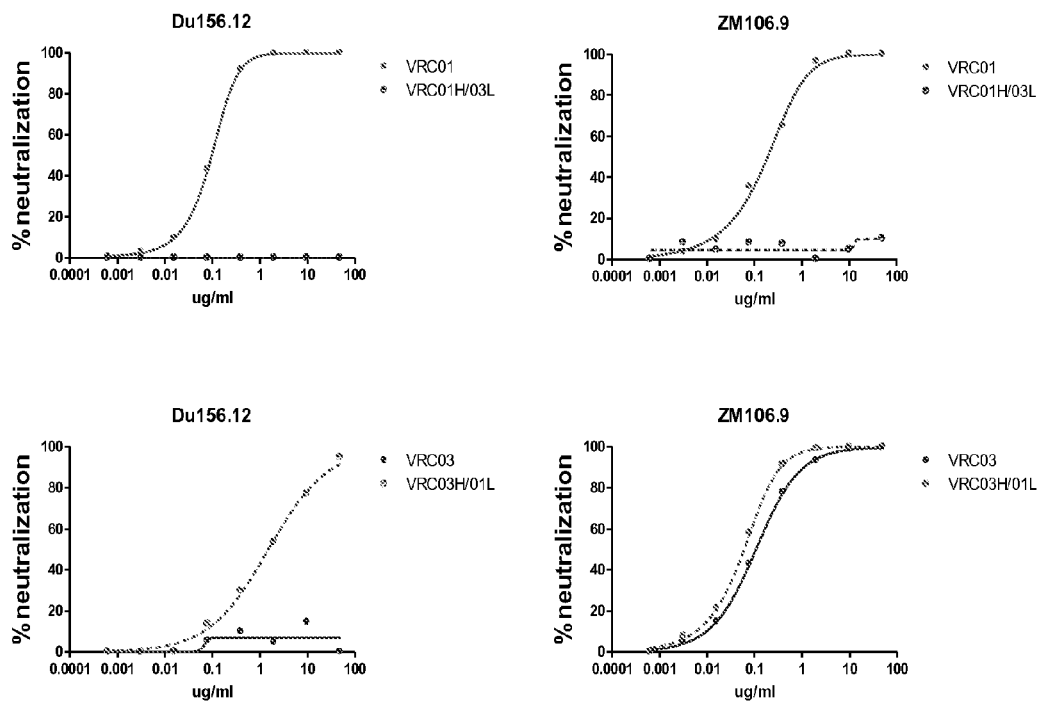
Figure 81A:
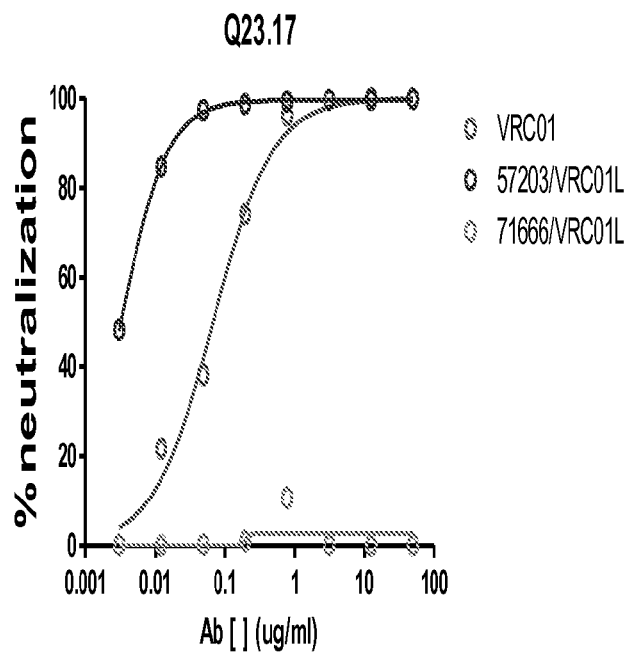
Figure 81B:
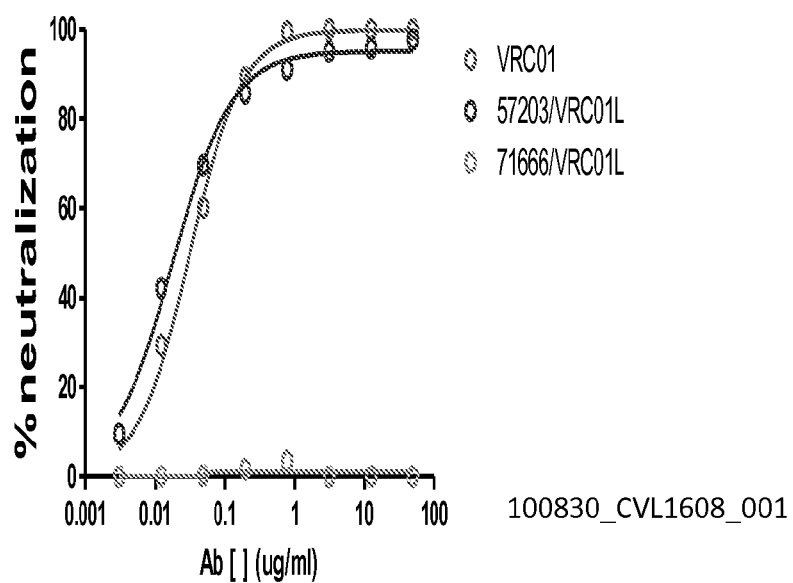
Figure 81C:
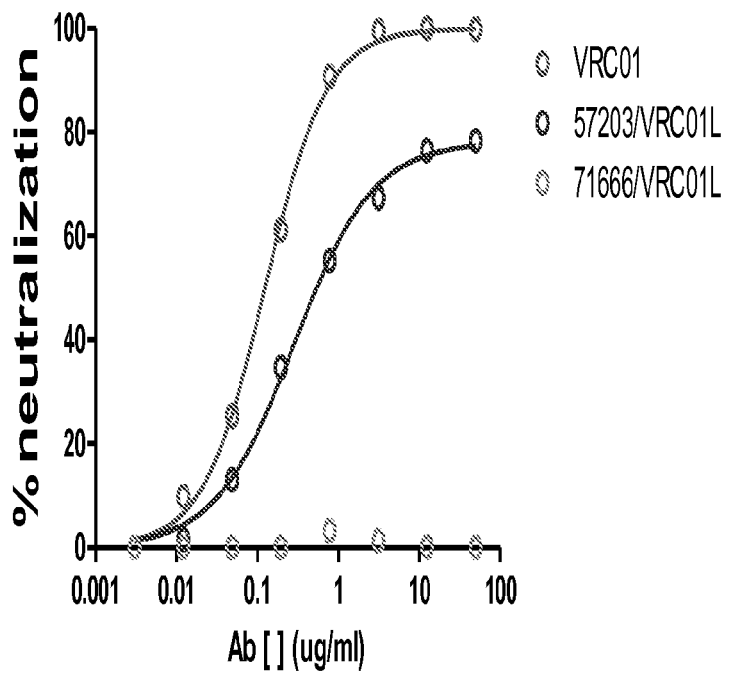
Figure 81D:
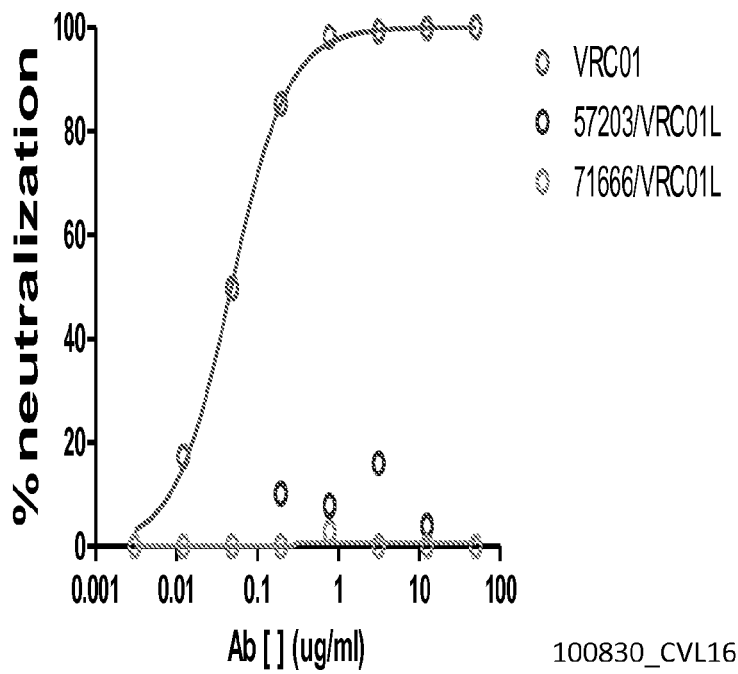
Figure 81E:
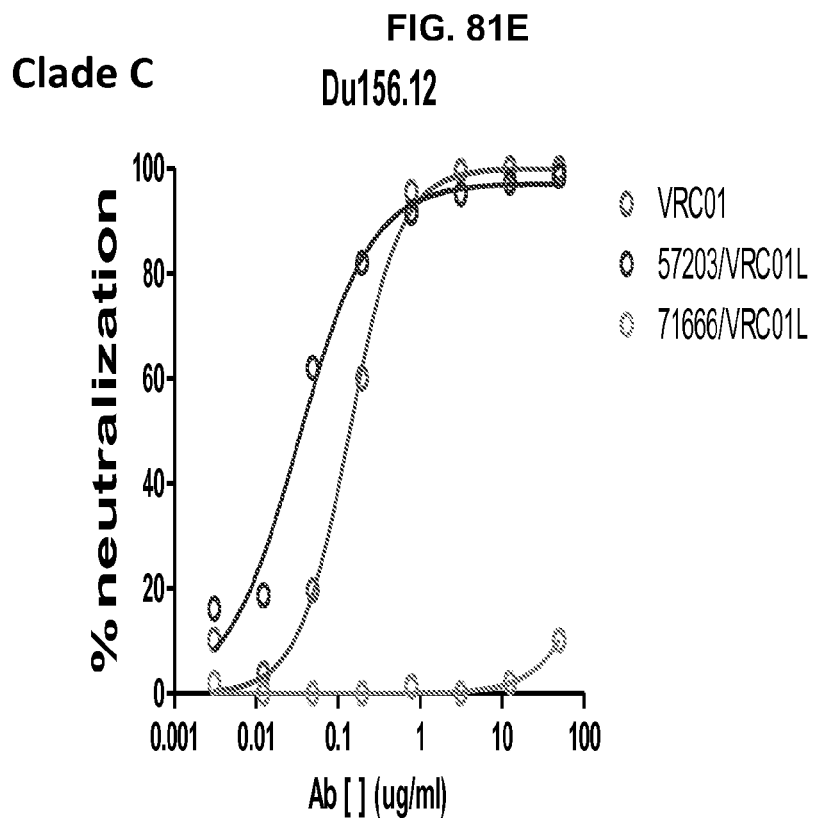
Figure 81F:
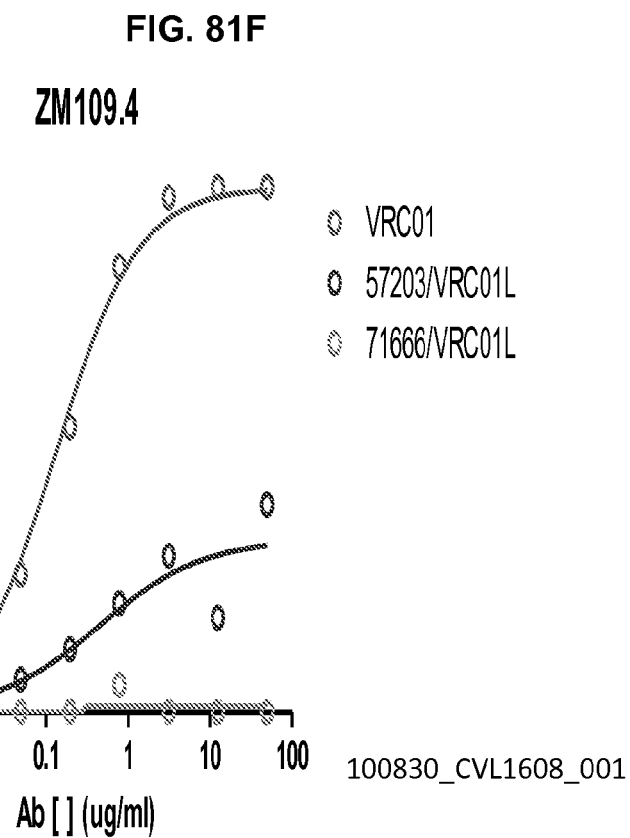
Figure 81G:
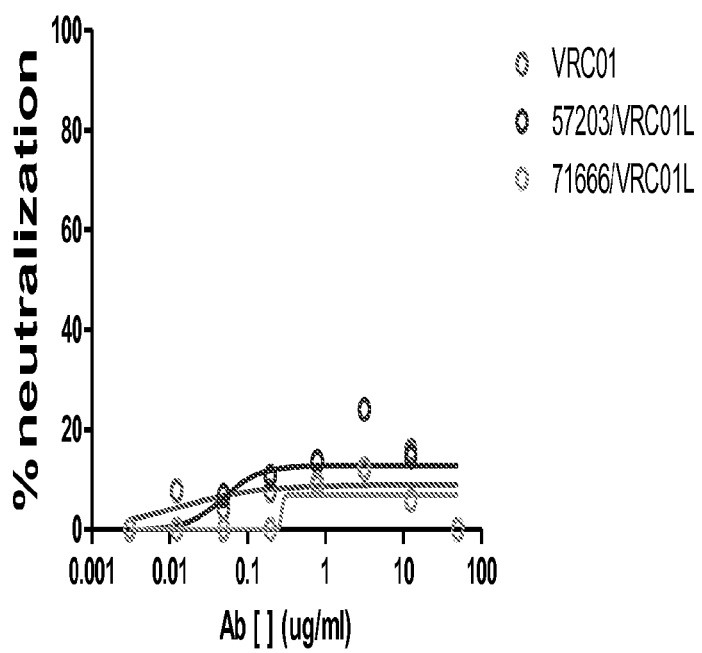
Figure 81H:
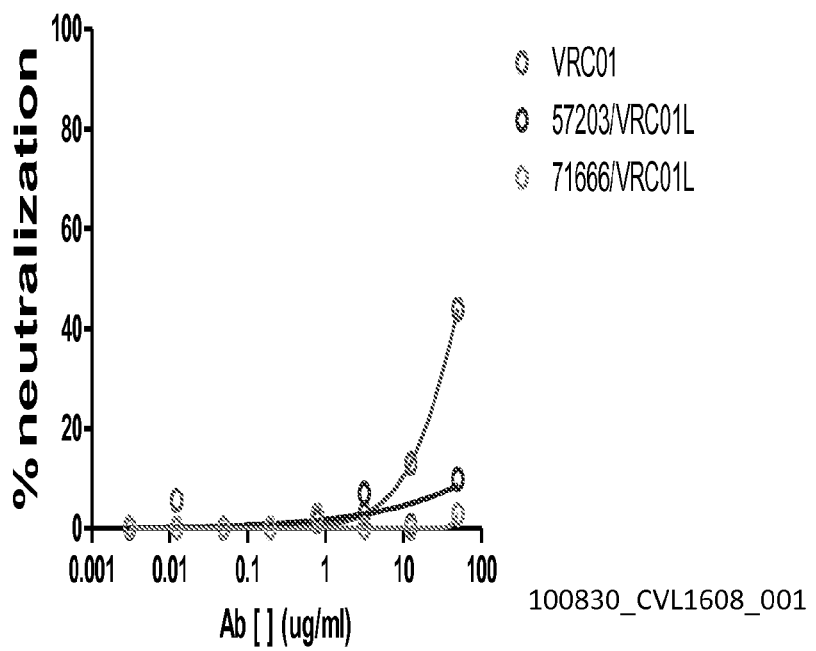

FIG. 79 is a set of graphs showing exemplary neutralization data for clade C HIV viruses obtained from VRC01 and VRC03 chimeric antibodies.

FIG. 80 is a sequence alignment of the amino acid sequence of the heavy chain of antibody 57203 (SEQ ID NO: 1322) identified by 454 sequencing, the germline sequence IGHV1-02*02 (SEQ ID NO: 41), VRC01 (SEQ ID NO: 1), VRC02 (SEQ ID NO: 3) and VRC03 (SEQ ID NO: 27).

FIGS. 81A-81H are a set of graphs of exemplary neutralization data of the 57203 heavy chain VRC01 light chain chimera demonstrating that the 57203 is VRC01 like, in that it complements the VRC01 light chain.

Figure 82:
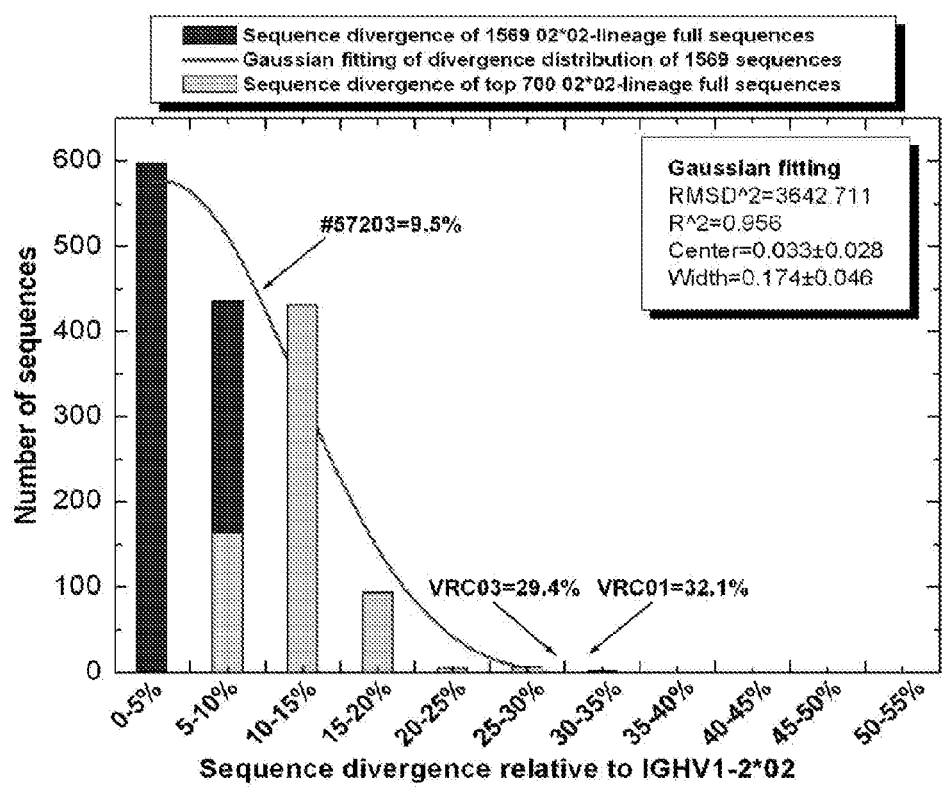
Figure 85:
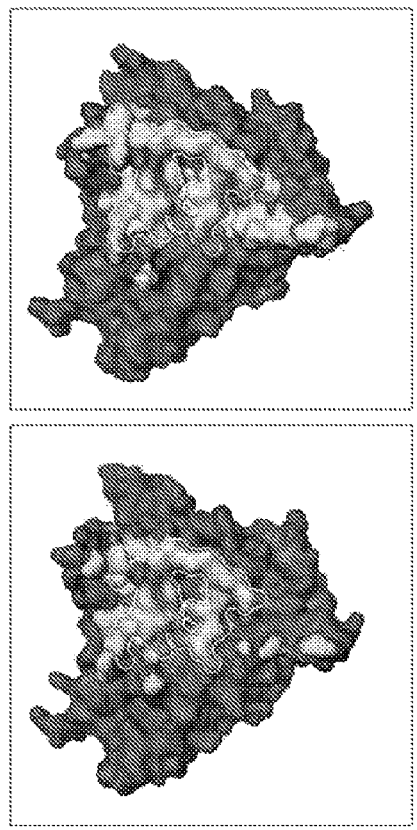
Figure 86:
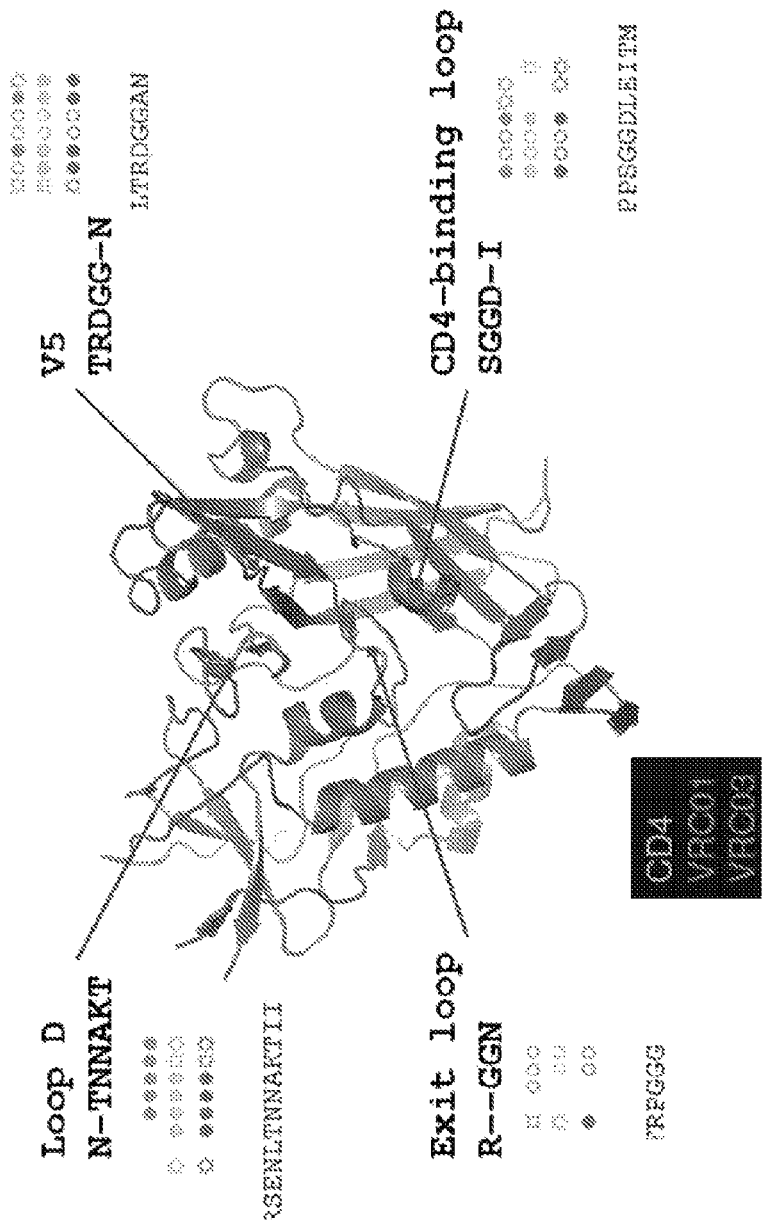
Figure 87:
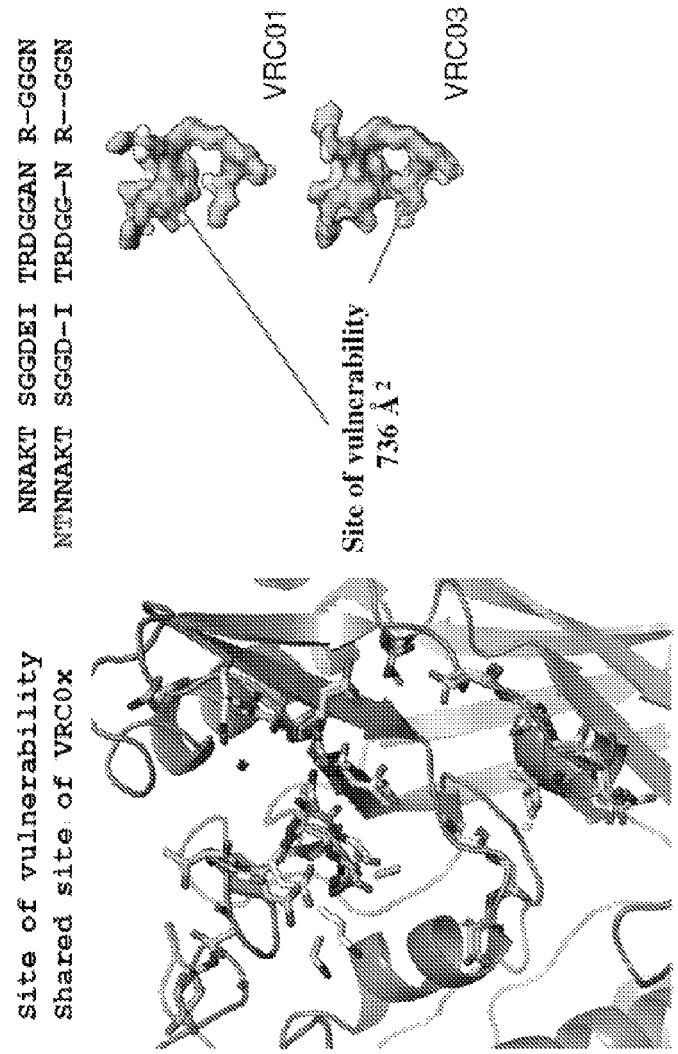
Figure 90:
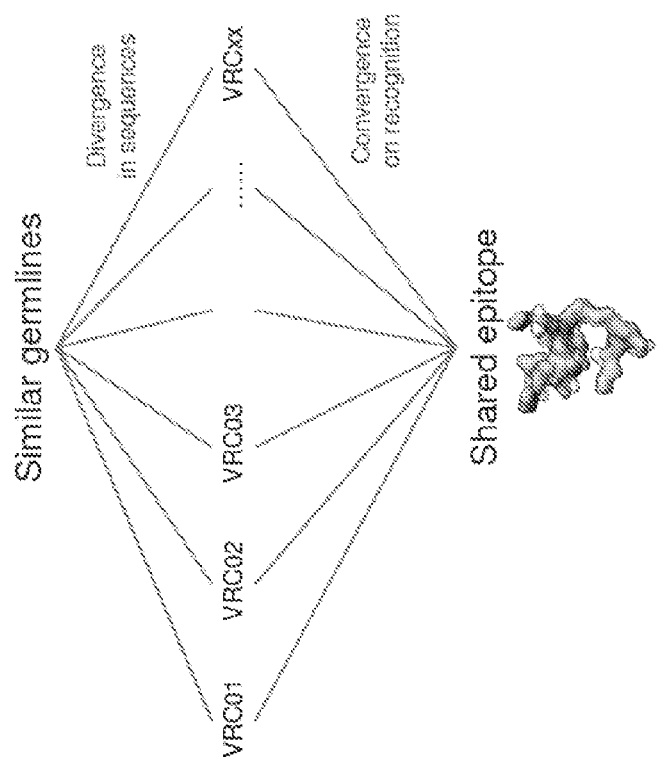
Figure 92A:
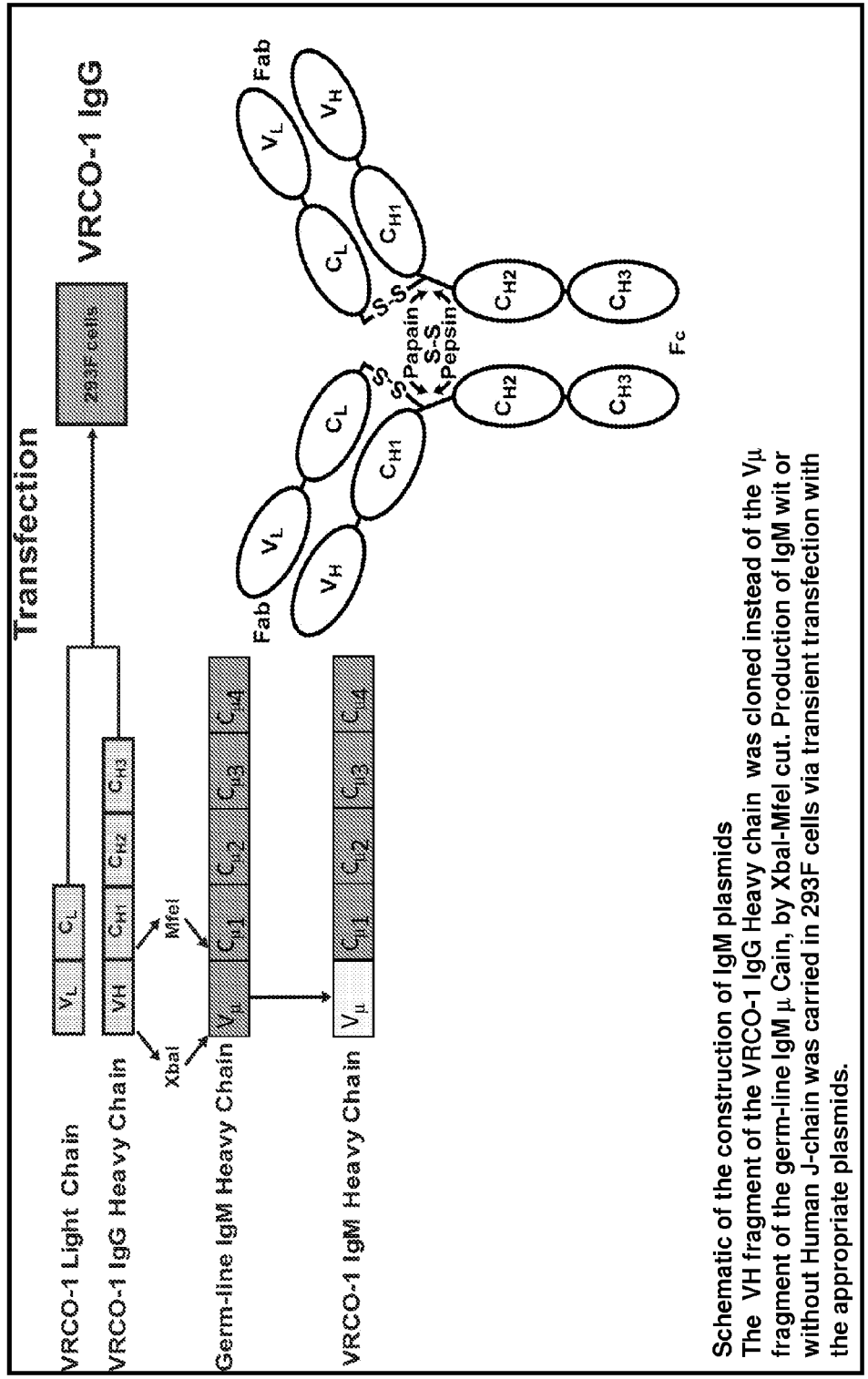
Figure 92C:
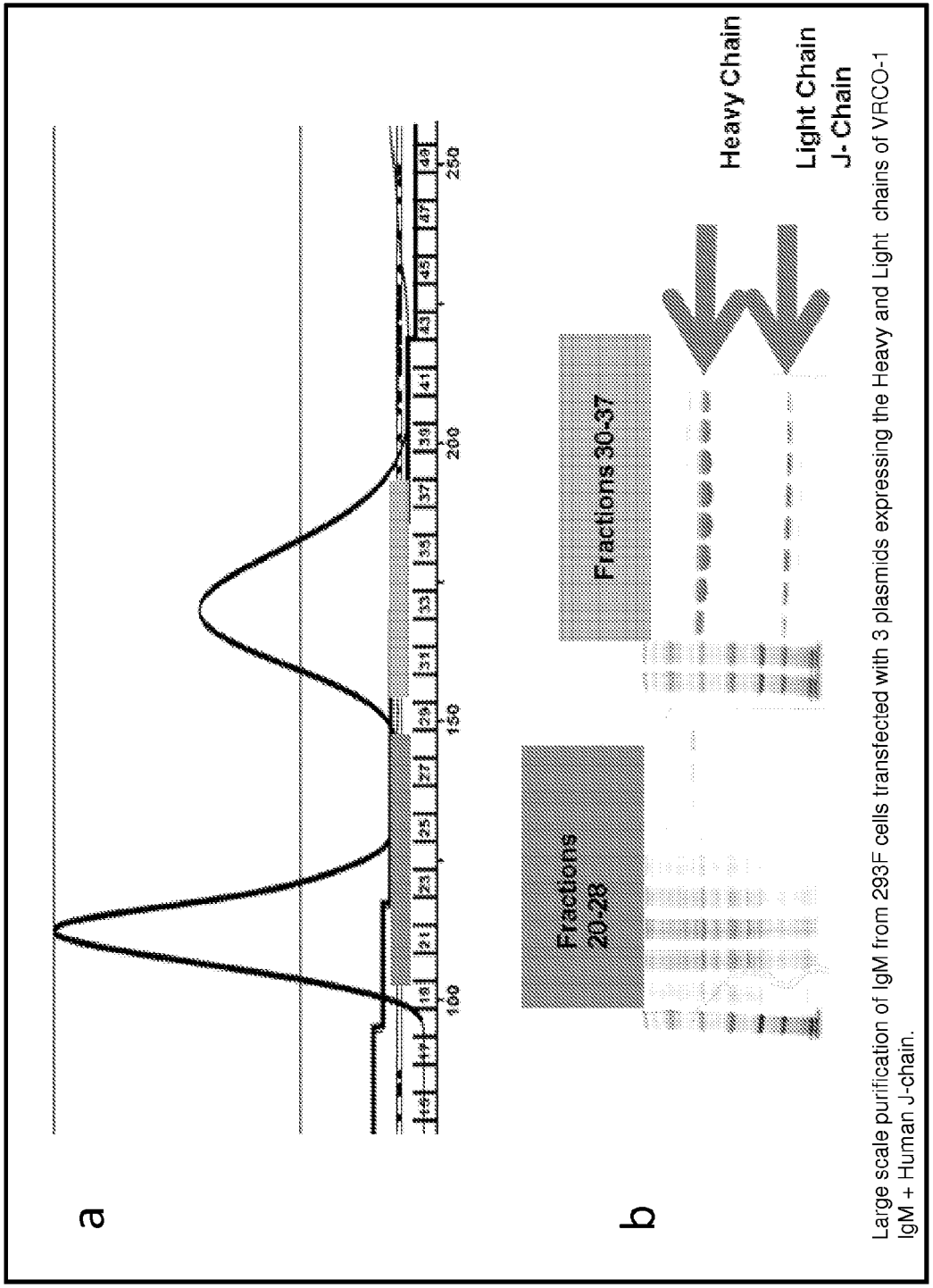
Figure 92E:
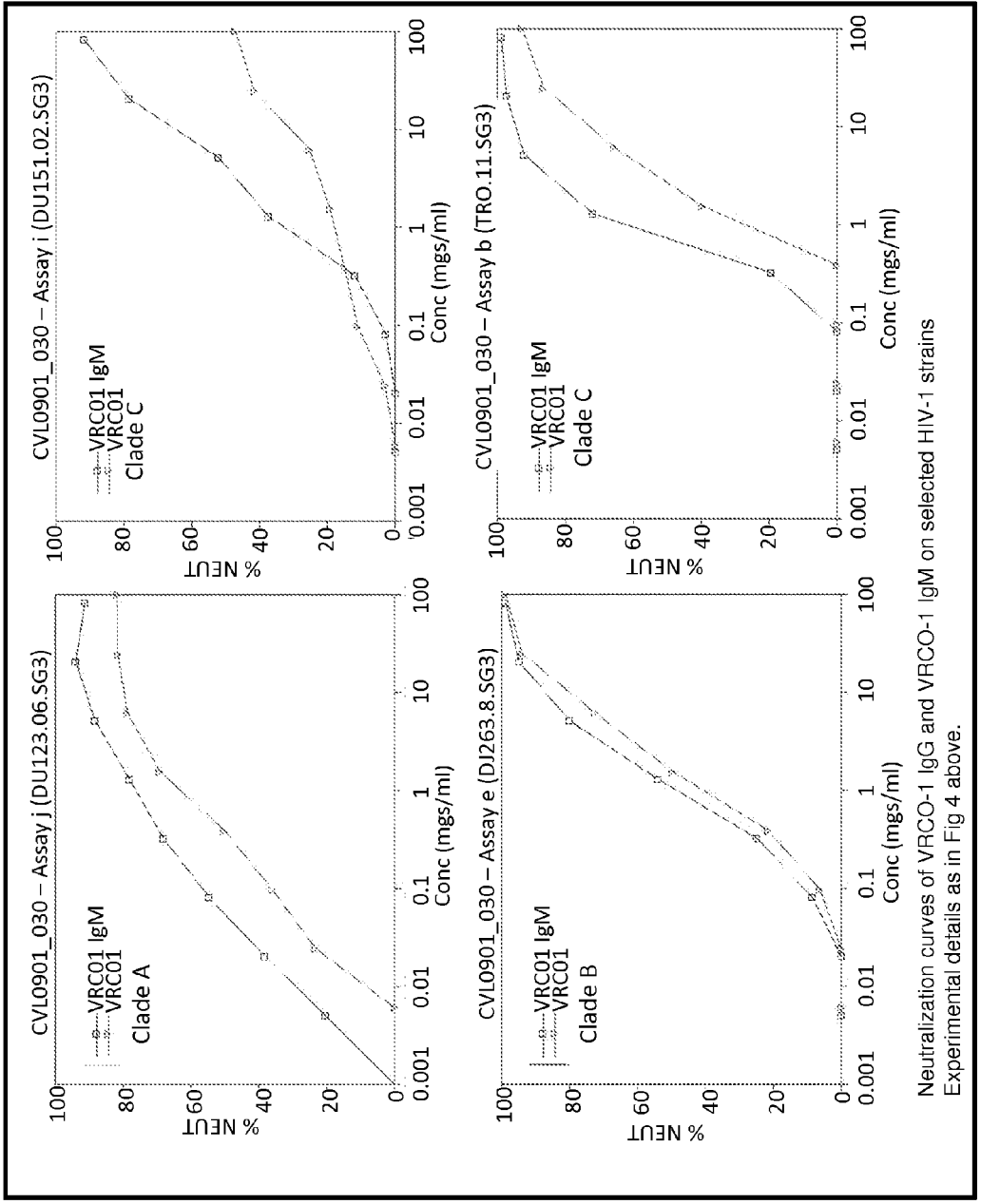
Figure 93:
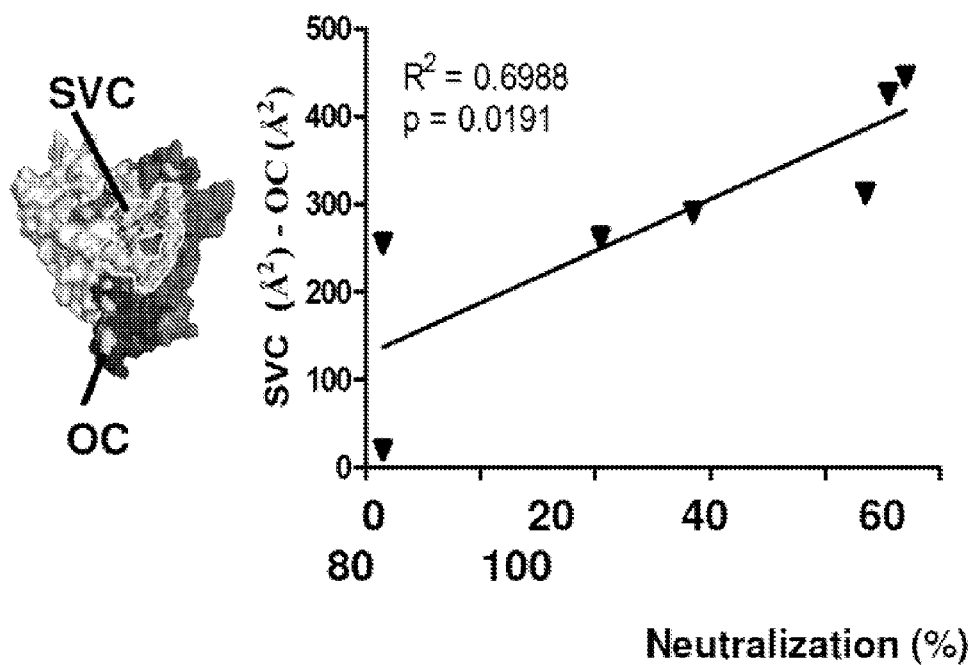
Figure 95:
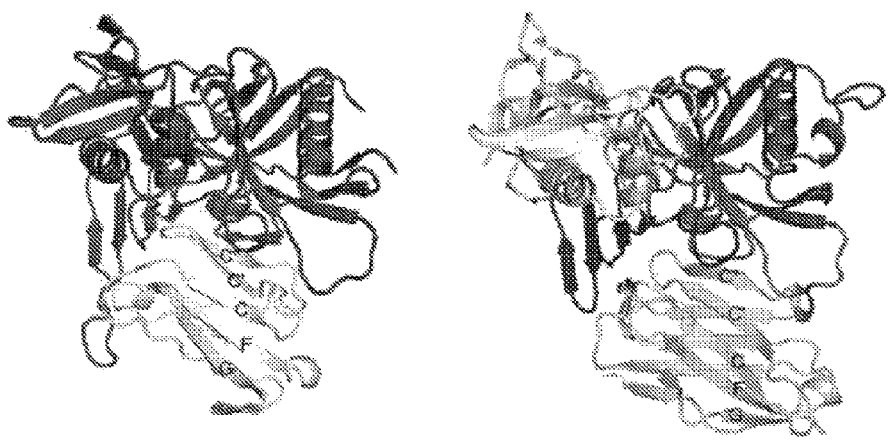
Figure 96:
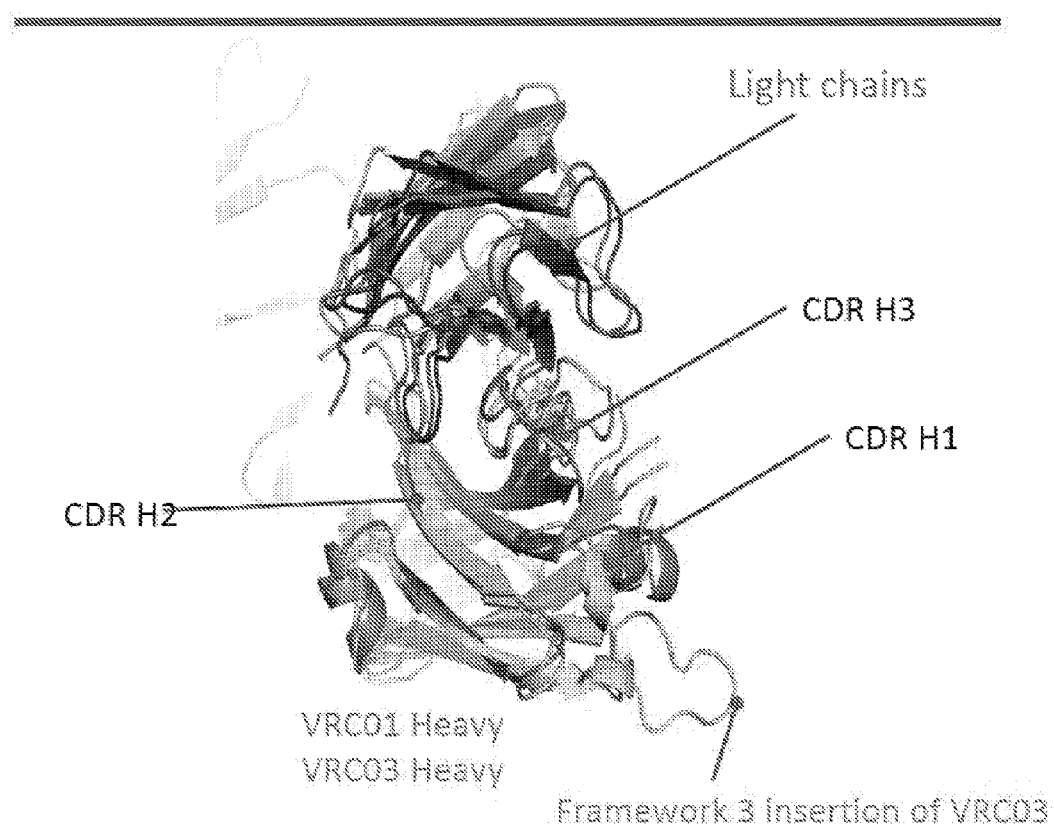
Figure 100:
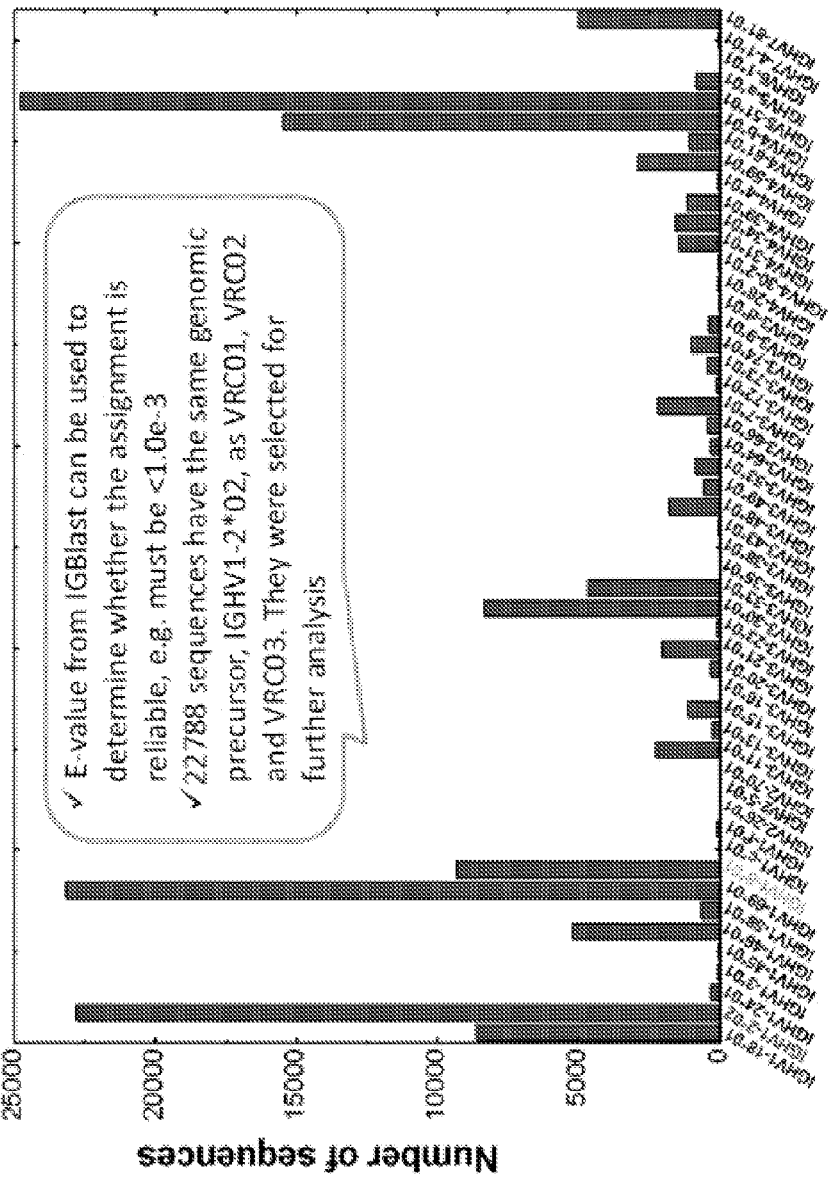
Figure 102:
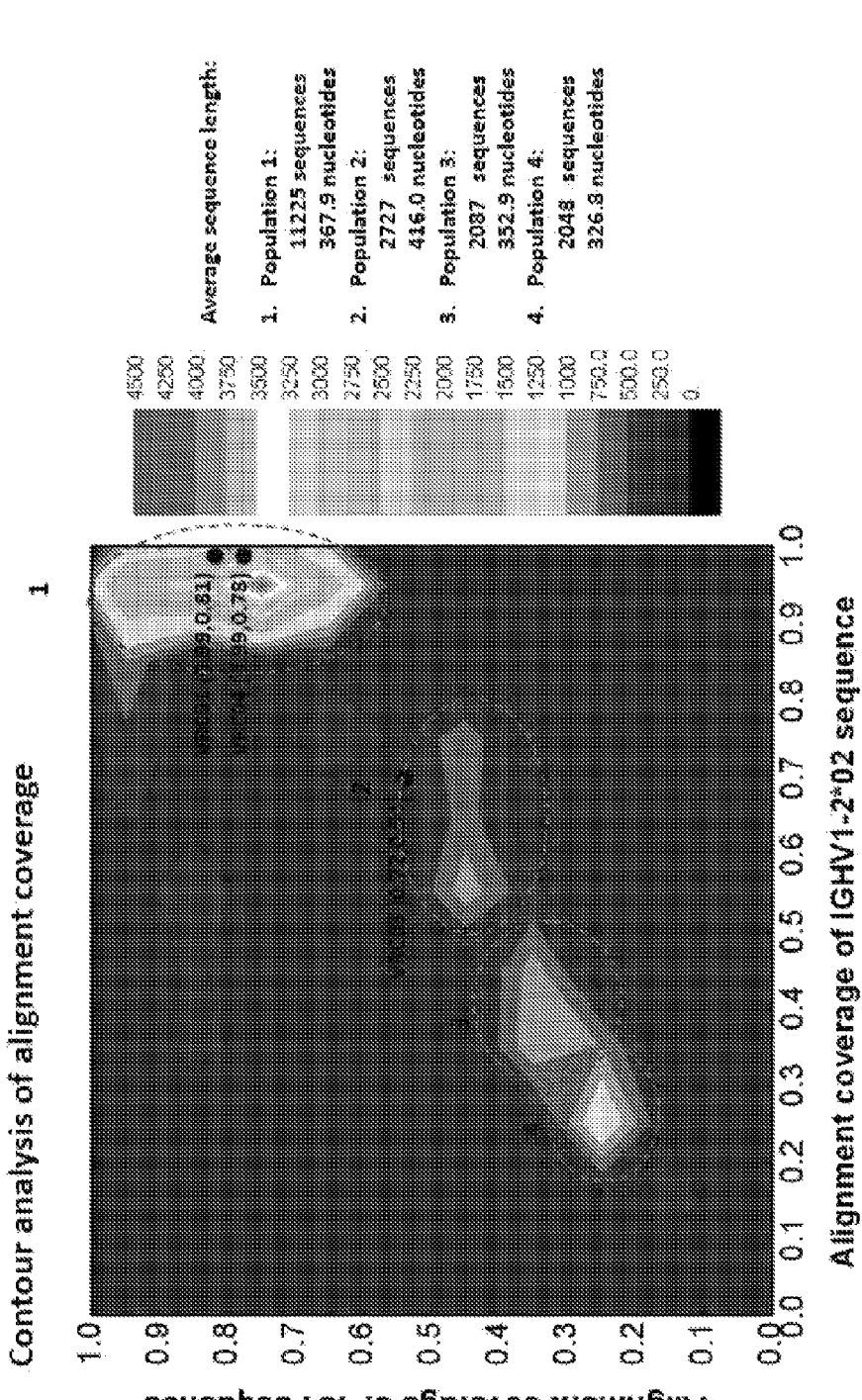
Figure 103:
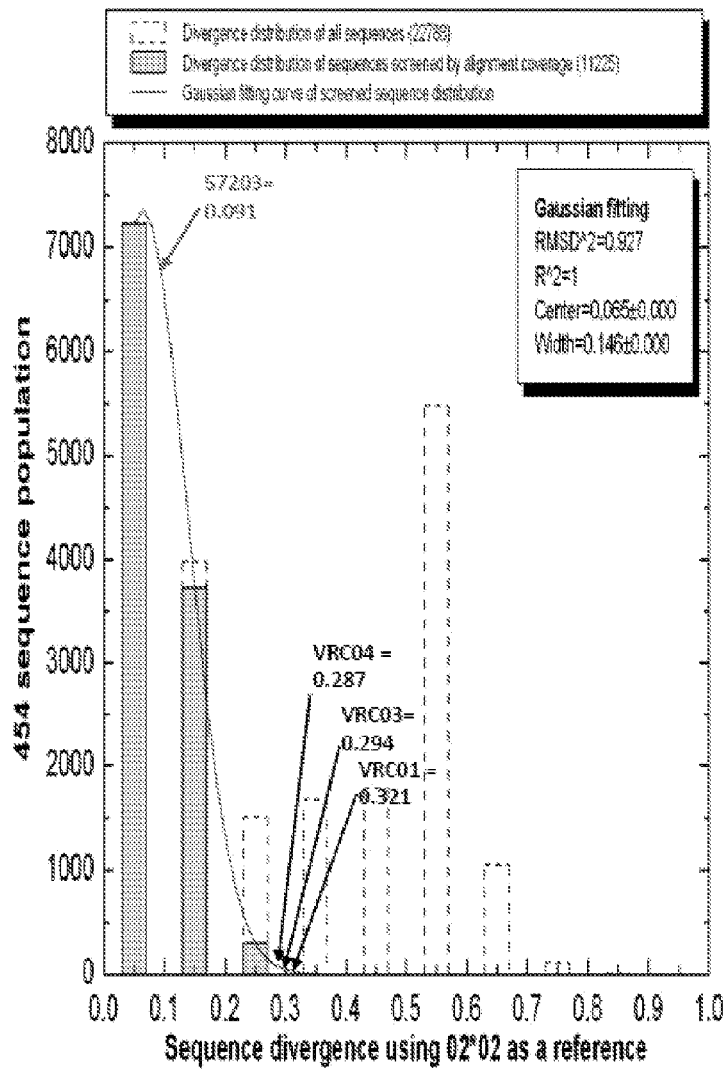
Figure 106:
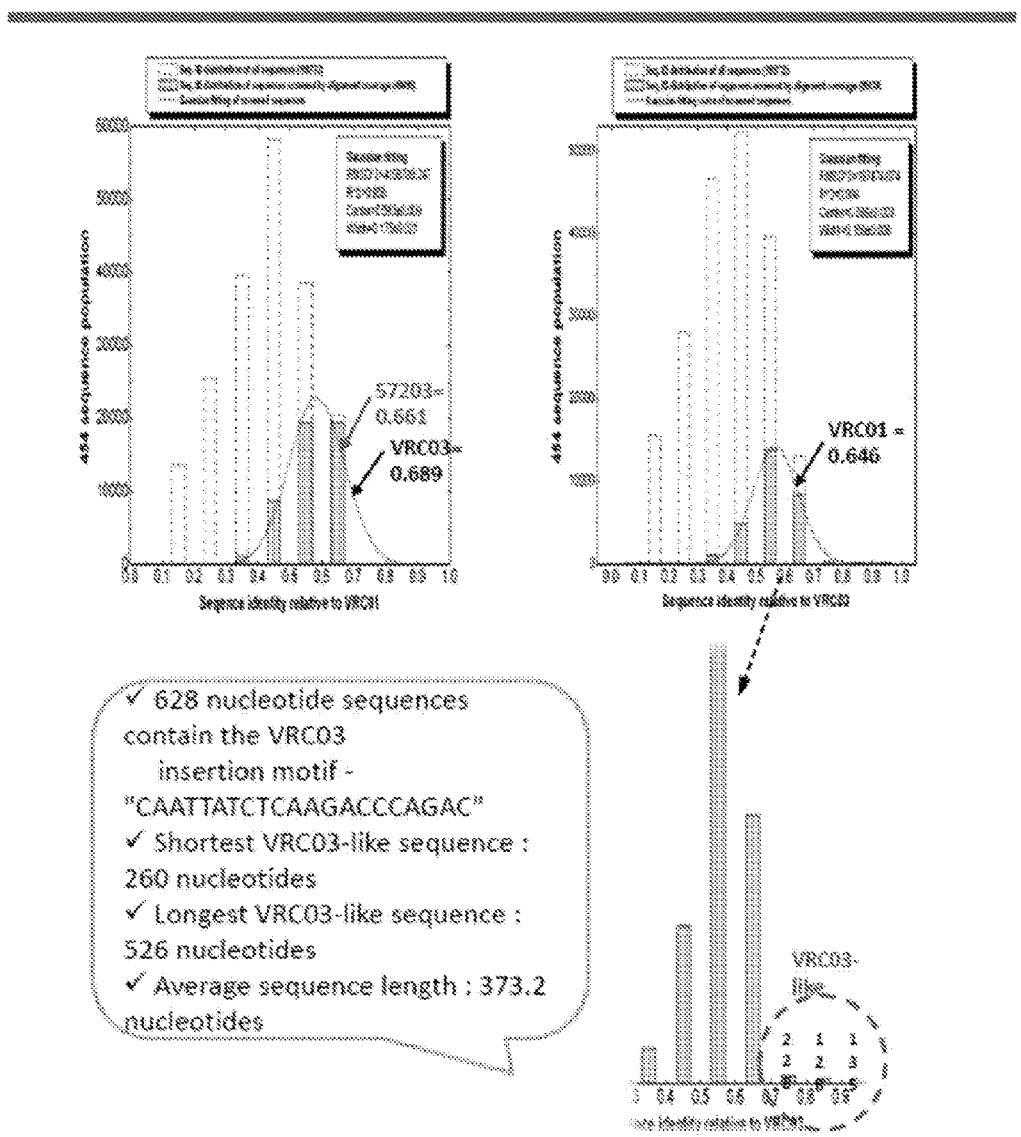
Figure 108:
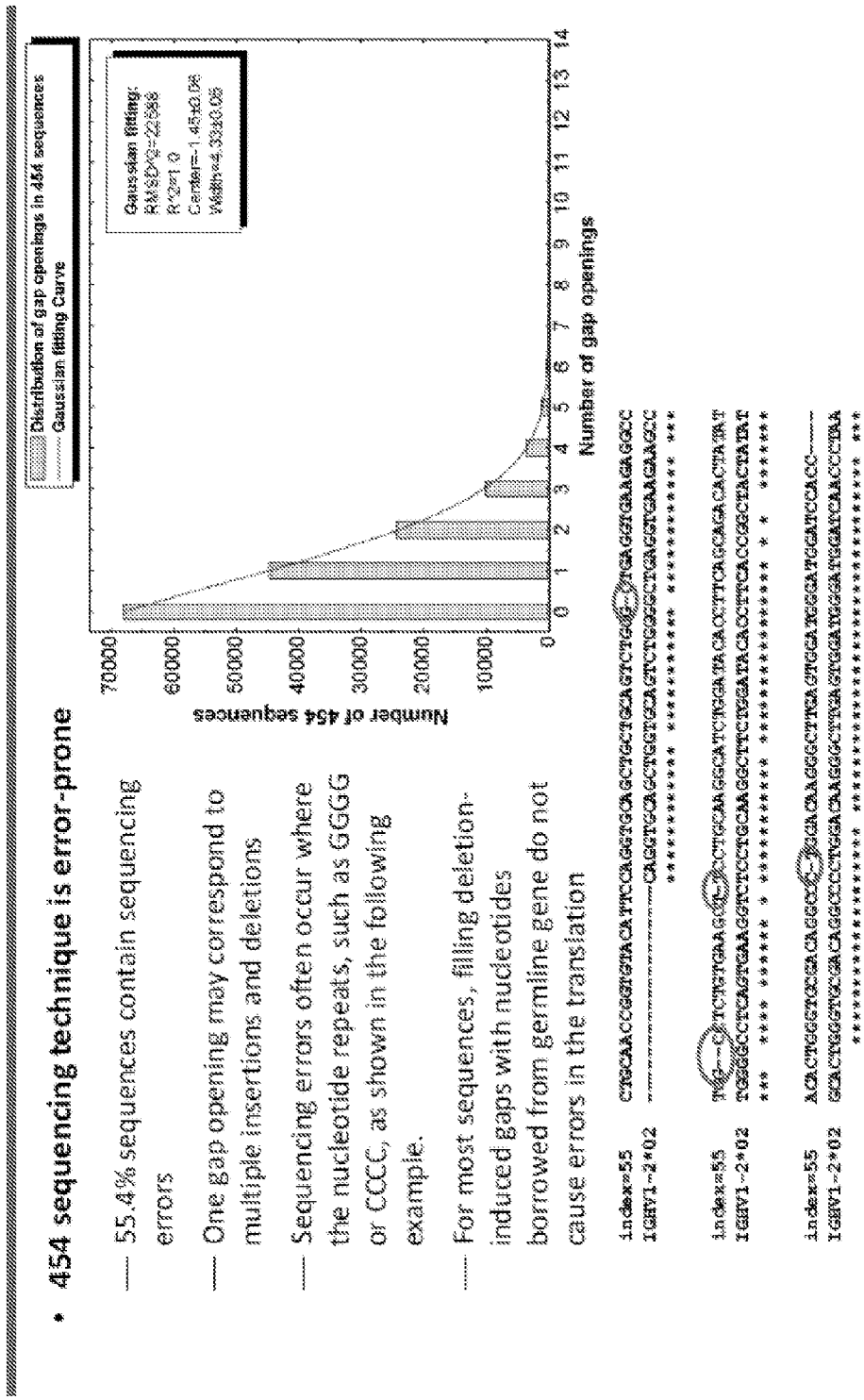
Figure 109:
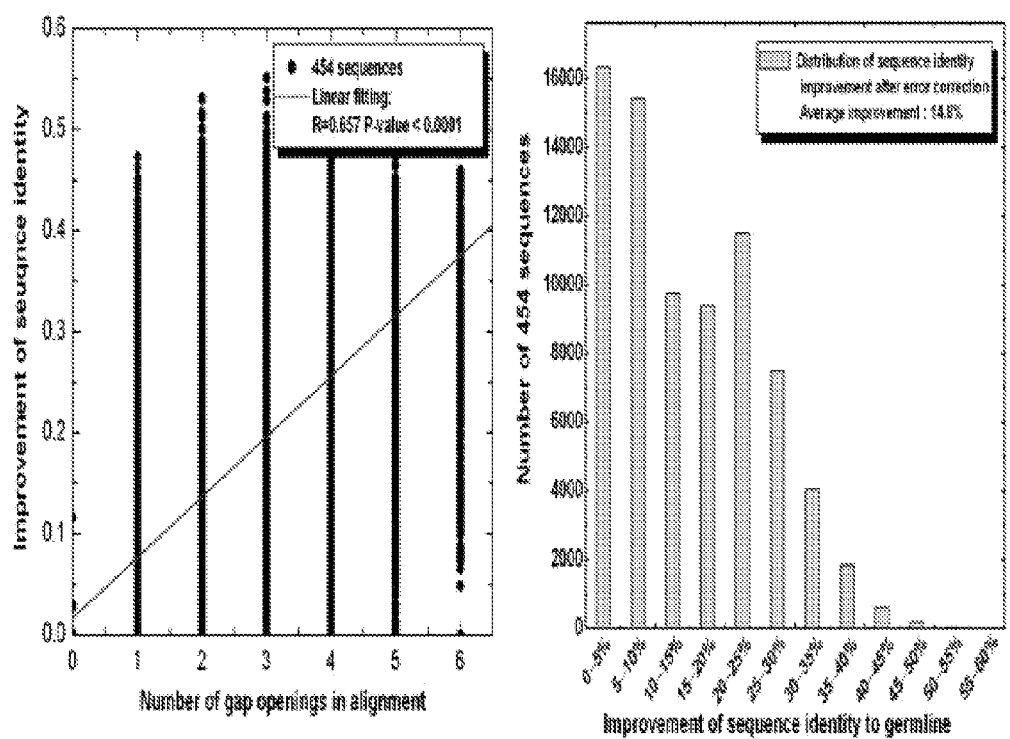
Figure 110:
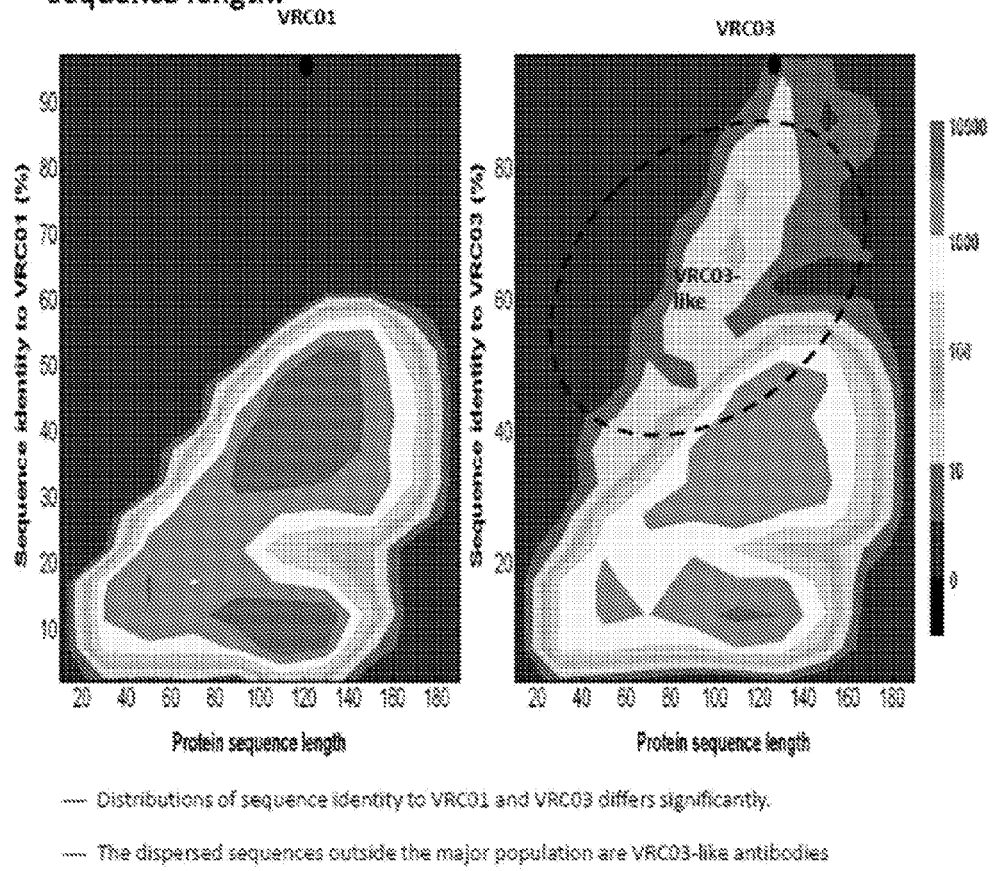

FIG. 82 is a graph showing the distribution of the VRC01 and VRC03 sequences set for as SEQ ID NOs: 760-1459.

FIGS. 83-91 and 93-97 are supporting data showing the conserved gp120 epitope common to the binding site of VRC01 and VRC03-like antibodies.

FIGS. 92A-92E show the production of VCR01 multimers.

FIGS. 97-117 are supporting data showing bioinformatics analysis.

SEQUENCE LISTING

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. In the accompanying sequence listing:

SEQ ID NO: 1 is the amino acid sequence of the heavy chain of gp120-specific antibody VRC01.

SEQ ID NO: 2 is the amino acid sequence of the light chain of gp120-specific antibody VRC01.

SEQ ID NO: 3 is the amino acid sequence of the heavy chain of gp120-specific antibody VRC02.

SEQ ID NO: 4 is the amino acid sequence of the light chain of gp120-specific antibody VRC02.

SEQ ID NO: 5 is the amino acid sequence of the heavy chain of gp41-specific antibody 2F5.

SEQ ID NO: 6 is the amino acid sequence of the heavy chain of gp41-specific antibody 2F5 $L_{100A}W$.

SEQ ID NO: 7 is the amino acid sequence of the heavy chain of gp41-specific antibody 2F5 $F_{100B}W$.

SEQ ID NO: 8 is the amino acid sequence of the heavy chain of gp41-specific antibody 2F5 $V_{100D}W$.

SEQ ID NO: 9 is the amino acid sequence of the heavy chain of gp41-specific antibody 2F5 $L_{100A}W$-$V_{100D}W$.

SEQ ID NO: 10 is the amino acid sequence of the light chain of gp41-specific antibody 2F5.

SEQ ID NO: 11 is the gp41 MPER Epitope Scaffold Immunological Probe ES1 (1LGYA) Clade B.

SEQ ID NO: 12 is the gp41 MPER Epitope Scaffold Immunological Probe ES1 (1LGYA) Clade B point mutant.

SEQ ID NO: 13 is the gp41 MPER Epitope Scaffold Immunological Probe ES1 (1LGYA) Clade C.

SEQ ID NO: 14 is the gp41 MPER Epitope Scaffold Immunological Probe ES2 (1KU2A-s) Clade B.

SEQ ID NO: 15 is the gp41 MPER Epitope Scaffold Immunological Probe ES2 (1KU2A-s) Clade B point mutant.

SEQ ID NO: 16 is the gp41 MPER Epitope Scaffold Immunological Probe ES2 (1KU2A-s) Clade C.

SEQ ID NO: 17 is the gp41 MPER Epitope Scaffold Immunological Probe ES3 (2MATA) Clade B.

SEQ ID NO: 18 is the gp41 MPER Epitope Scaffold Immunological Probe ES3 (2MATA) Clade B point mutant.

SEQ ID NO: 19 is the gp41 MPER Epitope Scaffold Immunological Probe ES3 (2MATA) Clade C.

SEQ ID NO: 20 is the gp41 MPER Epitope Scaffold Immunological Probe ES4 (11WLA) Clade B.

SEQ ID NO: 21 is the gp41 MPER Epitope Scaffold Immunological Probe ES4 (11WLA) Clade B point mutant.

SEQ ID NO: 22 is the gp41 MPER Epitope Scaffold Immunological Probe ES4 (11WLA) Clade C.

SEQ ID NO: 23 is the gp41 MPER Epitope Scaffold Immunological Probe ES5 (1D3BB) Clade B.

SEQ ID NO: 24 is the gp41 MPER Epitope Scaffold Immunological Probe ES5 (1D3BB) Clade B point mutant.

SEQ ID NO: 25 is the gp41 MPER Epitope Scaffold Immunological Probe ES5 (1D3BB) Clade C.

SEQ ID NO: 26 is the Avitag amino acid sequence.

SEQ ID NO: 27 is the amino acid sequence of the heavy chain of gp120-specific antibody VRC03.

SEQ ID NO: 28 is the amino acid sequence of the light chain of gp120-specific antibody VRC03.

SEQ ID NO: 29 is the nucleic acid sequence of the heavy chain of gp120-specific antibody VRC01.

SEQ ID NO: 30 is the nucleic acid sequence of the light chain of gp120-specific antibody VRC01.

SEQ ID NO: 31 is the nucleic acid sequence of the heavy chain of gp120-specific antibody VRC02.

SEQ ID NO: 32 is the nucleic acid sequence of the light chain of gp120-specific antibody VRC02.

SEQ ID NO: 33 is the nucleic acid sequence of the heavy chain of gp120-specific antibody VRC03.

SEQ ID NO: 34 is the nucleic acid sequence of the light chain of gp120-specific antibody VRC03.

SEQ ID NO: 35 is the nucleic acid sequence of VRC01 ImmunoAdhesin HL.

SEQ ID NO: 36 is the amino acid sequence of an exemplary mouse interleukin-2 (IL-2) leader sequence.

SEQ ID NO: 37 is the amino acid sequence of an exemplary gp120 V1N2 loop.

SEQ ID NO: 38 is the amino acid sequence of an exemplary gp120 V3 loop.

SEQ ID NO: 39 is the amino acid sequence of an exemplary peptide linker

SEQ ID NO: 40 is the amino acid sequence of an en exemplary peptide corresponding to residues 657 to 669 of linked to a C-terminal C9 tag.

SEQ ID NO: 41 is the amino acid sequence of the heavy chain of IGHV1-02*02.

SEQ ID NO: 42 is the amino acid sequence of the VK gene IGKV3-11*01.

SEQ ID NO: 43 is the amino acid sequence of the VK gene IGKV3-20*01.

SEQ ID NO: 44 is the amino acid sequence for the wild type clade B HXBc2 core gp120.

SEQ ID NO: 45 is the amino acid sequence for the wild type clade A/E 93TH057 core gp120.

SEQ ID NO: 46 is the amino acid sequence of a V5 region of a gp120.

SEQ ID NOs: 47-58 are the amino acids sequences of 2F5 CDR H3 loop mutants.

SEQ ID NO: 59 is the amino acid sequence of a V1/V2 trim sequence of gp120 from HIV SEQ ID NO: 60 is the nucleic acid sequence of VRC01 ImmunoAdhesin LH.

SEQ ID NOs: 61-759 are nucleic acid sequence of the heavy chains of VRC01 and VRC03-like antibodies.

SEQ ID NOs: 760-1459 are amino acid sequence of the heavy chains of VRC01 and VRC03-like antibodies.

The Sequence Listing is submitted as an ASCII text file in the form of the file named Sequence.txt, which was created on Mar. 22, 2012, and is ~1.3 MB, which is incorporated by reference herein.

DETAILED DESCRIPTION

I. Terms

Unless otherwise noted, technical terms are used according to conventional usage. Definitions of common terms in molecular biology can be found in Benjamin Lewin, Genes V, published by Oxford University Press, 1994 (ISBN 0-19-854287-9); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8). Terms describing protein structure and structural elements of proteins can be found in Creighton, Proteins, Structures and Molecular Properties, W.H. Freeman & Co., New York, 1993 (ISBN 0-717-7030) which is incorporated by reference herein in its entirety.

Unless otherwise explained, all technical and scientific terms used herein have the same meaning as commonly understood by one of ordinary skill in the art to which this disclosure belongs. The singular terms "a," "an," and "the" include plural referents unless context clearly indicates otherwise. Similarly, the word "or" is intended to include "and" unless the context clearly indicates otherwise.

It is further to be understood that all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described below. In case of conflict, the present specification, including explanations of terms, will control. In addition, the materials, methods, and examples are illustrative only and not intended to be limiting.

To facilitate review of the various embodiments of this disclosure, the following explanations of terms are provided:

Administration: The introduction of a composition into a subject by a chosen route. Administration can be local or systemic. For example, if the chosen route is intravenous, the composition is administered by introducing the composition into a vein of the subject. In some examples a disclosed antibody specific for an HIV protein or polypeptide is administered to a subject.

Amino acid substitution: The replacement of one amino acid in peptide with a different amino acid.

Amplification: A technique that increases the number of copies of a nucleic acid molecule (such as an RNA or DNA). An example of amplification is the polymerase chain reaction, in which a biological sample is contacted with a pair of oligonucleotide primers, under conditions that allow for the hybridization of the primers to a nucleic acid template in the sample. The primers are extended under suitable conditions, dissociated from the template, and then re-annealed, extended, and dissociated to amplify the number of copies of the nucleic acid. The product of amplification can be characterized by electrophoresis, restriction endonuclease cleavage patterns, oligonucleotide hybridization or ligation, and/or nucleic acid sequencing using standard techniques. Other examples of amplification include strand displacement amplification, as disclosed in U.S. Pat. No. 5,744,311; transcription-free isothermal amplification, as disclosed in U.S. Pat. No. 6,033,881; repair chain reaction amplification, as disclosed in WO 90/01069; ligase chain reaction amplification, as disclosed in EP-A-320 308; gap filling ligase chain reaction amplification, as disclosed in U.S. Pat. No. 5,427,930; and NASBA™ RNA transcription-free amplification, as disclosed in U.S. Pat. No. 6,025,134.

Animal: Living multi-cellular vertebrate organisms, a category that includes, for example, mammals and birds. The term mammal includes both human and non-human mammals. Similarly, the term "subject" includes both human and veterinary subjects.

Antibody: A polypeptide substantially encoded by an immunoglobulin gene or immunoglobulin genes, or antigen binding fragments thereof, which specifically binds and recognizes an analyte (antigen) such as gp120, or gp41 or an antigenic fragment of gp120 or gp41. Immunoglobulin genes include the kappa, lambda, alpha, gamma, delta, epsilon and mu constant region genes, as well as the myriad immunoglobulin variable region genes.

Antibodies exist, for example as intact immunoglobulins and as a number of well characterized fragments produced by digestion with various peptidases. For instance, Fabs, Fvs, and single-chain Fvs (scFvs) that specifically bind to gp120 or fragments of gp120 would be gp120-specific binding agents. Similarly, Fabs, Fvs, scFvs that specifically bind to gp41 or fragments of gp41 would be gp41-specific binding agents. A scFv protein is a fusion protein in which a light chain variable region of an immunoglobulin and a heavy chain variable region of an immunoglobulin are bound by a linker, while in dsFvs, the chains have been mutated to introduce a disulfide bond to stabilize the association of the chains. The term also includes genetically engineered forms such as chimeric antibodies (such as humanized murine antibodies), heteroconjugate antibodies such as bispecific antibodies). See also, *Pierce Catalog and Handbook*, 1994-1995 (Pierce Chemical Co., Rockford, Ill.); Kuby, J., *Immunology*, 3$^{rd}$ Ed., W.H. Freeman & Co., New York, 1997.

Antibody fragments are defined as follows: (1) Fab, the fragment which contains a monovalent antigen-binding fragment of an antibody molecule produced by digestion of whole antibody with the enzyme papain to yield an intact light chain and a portion of one heavy chain; (2) Fab', the fragment of an antibody molecule obtained by treating whole antibody with pepsin, followed by reduction, to yield an intact light chain and a portion of the heavy chain; two Fab' fragments are obtained per antibody molecule; (3) (Fab')$_2$, the fragment of the antibody obtained by treating whole antibody with the enzyme pepsin without subsequent reduction; (4) F(ab')$_2$, a dimer of two Fab' fragments held together by two disulfide bonds; (5) Fv, a genetically engineered fragment containing the variable region of the light chain and the variable region of the heavy chain expressed as two chains; and (6) single chain antibody ("SCA"), a genetically engineered molecule containing the variable region of the light chain, the variable region of the heavy chain, linked by a suitable polypeptide linker as a genetically fused single chain molecule. The term "antibody," as used herein, also includes antibody fragments either produced by the modification of whole antibodies or those synthesized de novo using recombinant DNA methodologies.

Typically, a naturally occurring immunoglobulin has heavy (H) chains and light (L) chains interconnected by disulfide bonds. There are two types of light chain, lambda (λ) and kappa (κ). There are five main heavy chain classes (or isotypes) which determine the functional activity of an antibody molecule: IgM, IgD, IgG, IgA and IgE.

Each heavy and light chain contains a constant region and a variable region (the regions are also known as "domains"). In combination, the heavy and the light chain variable regions specifically bind the antigen. Light and heavy chain variable regions contain a "framework" region interrupted by three hypervariable regions, also called "complementarity-determining regions" or "CDRs." The extent of the framework region and CDRs have been defined (see, Kabat et al., *Sequences of Proteins of Immunological Interest*, U.S. Department of Health and Human Services, 1991, which is hereby incorporated by reference in its entirety). Thus one of ordinary skill in the art will recognize the numbering of the residues in the disclosed antibodies is made with reference to the Kabat or Immunogenetics (IMGT) convention. The Kabat database is now maintained online. The sequences of the framework regions of different light or heavy chains are relatively conserved within a species. The framework region of an antibody, that is the combined framework regions of the constituent light and heavy chains, serves to position and align the CDRs in three-dimensional space.

The CDRs are primarily responsible for binding to an epitope of an antigen. The CDRs of each chain are typically referred to as CDR1, CDR2, and CDR3, numbered sequentially starting from the N-terminus, and are also typically identified by the chain in which the particular CDR is located. Thus, a $V_H$ CDR3 is located in the variable domain of the heavy chain of the antibody in which it is found, whereas a $V_L$ CDR1 is the CDR1 from the variable domain of the light chain of the antibody in which it is found. Light chain CDRs are sometimes referred to as CDR L1, CDR L2, and CDR L3. Heavy chain CDRs are sometimes referred to as CDR H1, CDR H2, and CDR H3.

References to "$V_H$" or "VH" refer to the variable region of an immunoglobulin heavy chain, including that of an antibody fragment, such as Fv, scFv, dsFv or Fab. References to "$V_L$" or "VL" refer to the variable region of an immunoglobulin light chain, including that of an Fv, scFv, dsFv or Fab.

A "monoclonal antibody" is an antibody produced by a single clone of B-lymphocytes or by a cell into which the light and heavy chain genes of a single antibody have been transfected. Monoclonal antibodies are produced by methods known to those of skill in the art, for instance by making hybrid antibody-forming cells from a fusion of myeloma cells with immune spleen cells. These fused cells and their progeny are termed "hybridomas." Monoclonal antibodies include humanized monoclonal antibodies. In some examples monoclonal antibodies are isolated from a subject. The amino acid sequences of such isolated monoclonal antibodies can be determined.

A "humanized" immunoglobulin is an immunoglobulin including a human framework region and one or more CDRs from a non-human (such as a mouse, rat, or synthetic) immunoglobulin. The non-human immunoglobulin providing the CDRs is termed a "donor," and the human immunoglobulin providing the framework is termed an "acceptor." In one embodiment, all the CDRs are from the donor immunoglobulin in a humanized immunoglobulin. Constant regions need not be present, but if they are, they must be substantially identical to human immunoglobulin constant regions, such as at least about 85-90%, such as about 95% or more identical. Hence, all parts of a humanized immunoglobulin, except possibly the CDRs, are substantially identical to corresponding parts of natural human immunoglobulin sequences. A "humanized antibody" is an antibody comprising a humanized light chain and a humanized heavy chain immunoglobulin. A humanized antibody binds to the same antigen as the donor antibody that provides the CDRs. The acceptor framework of a humanized immunoglobulin or antibody may have a limited number of substitutions by amino acids taken from the donor framework. Humanized or other monoclonal antibodies can have additional conservative amino acid substitutions which have substantially no effect on antigen binding or other immunoglobulin functions. Humanized immunoglobulins can be constructed by means of genetic engineering (for example, see U.S. Pat. No. 5,585,089).

Antigen: A compound, composition, or substance that can stimulate the production of antibodies or a T cell response in an animal, including compositions that are injected or absorbed into an animal. An antigen reacts with the products of specific humoral or cellular immunity, including those induced by heterologous antigens, such as the disclosed antigens. "Epitope" or "antigenic determinant" refers to the region of an antigen to which B and/or T cells respond. In one embodiment, T cells respond to the epitope, when the epitope is presented in conjunction with an MHC molecule. Epitopes can be formed both from contiguous amino acids or noncontiguous amino acids juxtaposed by tertiary folding of a protein. Epitopes formed from contiguous amino acids are typically retained on exposure to denaturing solvents whereas epitopes formed by tertiary folding are typically lost on treatment with denaturing solvents. An epitope typically includes at least 3, and more usually, at least 5, about 9, or about 8-10 amino acids in a unique spatial conformation. Methods of determining spatial conformation of epitopes include, for example, x-ray crystallography and nuclear magnetic resonance.

Examples of antigens include, but are not limited to, peptides, lipids, polysaccharides, and nucleic acids containing antigenic determinants, such as those recognized by an immune cell. In some examples, antigens include peptides derived from a pathogen of interest. Exemplary pathogens include bacteria, fungi, viruses and parasites. In specific examples, an antigen is derived from HIV, such as a gp120 polypeptide or antigenic fragment thereof, such as a gp120 outer domain or fragment thereof. In other examples an antigen a gp41 polypeptide derived from HIV or antigenic fragment thereof.

A "target epitope" is a specific epitope on an antigen that specifically binds a antibody of interest, such as a monoclonal antibody. In some examples, a target epitope includes the amino acid residues that contact the antibody of interest, such that the target epitope can be selected by the amino acid residues determined to be in contact with the antibody of interest.

Antigenic surface: A surface of a molecule, for example a protein such as a gp120 protein or polypeptide, capable of eliciting an immune response. An antigenic surface includes the defining features of that surface, for example the three-dimensional shape and the surface charge. An antigenic surface includes both surfaces that occur on gp120 polypeptides as well as surfaces of compounds that mimic the surface of a gp120 polypeptide (mimetics). In some examples, an antigenic surface include all or part of the surface of gp120 that binds to the CD4 receptor.

Atomic Coordinates or Structure coordinates: Mathematical coordinates derived from mathematical equations related to the patterns obtained on diffraction of a monochromatic beam of X-rays by the atoms (scattering centers) such as an antigen, or an antigen in complex with an antibody. In some examples that antigen can be gp120, a gp120:antibody complex, or combinations thereof in a crystal. In some examples that antigen can be gp41, a gp41:antibody complex, or combinations thereof in a crystal. The diffraction data are used to calculate an electron density map of the repeating unit of the crystal. The electron density maps are used to establish the positions of the individual atoms within the unit cell of the crystal. In one example, the term "structure coordinates" refers to Cartesian coordinates derived from mathematical equations related to the patterns obtained on diffraction of a monochromatic beam of X-rays, such as by the atoms of a gp120 in crystal form.

Those of ordinary skill in the art understand that a set of structure coordinates determined by X-ray crystallography is not without standard error. For the purpose of this disclosure, any set of structure coordinates that have a root mean square deviation of protein backbone atoms (N, Cα, C and 0) of less than about 1.0 Angstroms when superimposed, such as about 0.75, or about 0.5, or about 0.25 Angstroms, using backbone atoms, shall (in the absence of an explicit statement to the contrary) be considered identical.

Binding affinity: Affinity of an antibody or antigen binding fragment thereof for an antigen. In one embodiment, affinity is calculated by a modification of the Scatchard method described by Frankel et al., *Mol. Immunol.,* 16:101-106, 1979. In another embodiment, binding affinity is measured by an antigen/antibody dissociation rate. In yet another embodiment, a high binding affinity is measured by a competition radioimmunoassay. In several examples, a high binding affinity is at least about $1\times10^{-8}$ M. In other embodiments, a high binding affinity is at least about $1.5\times10^{-8}$, at least about $2.0\times10^{-8}$, at least about $2.5\times10^{-8}$, at least about $3.0\times10^{-8}$, at least about $3.5\times10^{-8}$, at least about $4.0\times10^{-8}$, at least about $4.5\times10^{-8}$, or at least about $5.0\times10^{-8}$ M.

CD4: Cluster of differentiation factor 4 polypeptide; a T-cell surface protein that mediates interaction with the MHC class II molecule. CD4 also serves as the primary receptor site for HIV on T-cells during HIV-I infection. CD4 is known to bind to gp120 from HIV. The known sequence of the CD4 precursor has a hydrophobic signal peptide, an extracellular region of approximately 370 amino acids, a highly hydrophobic stretch with significant identity to the membrane-spanning domain of the class II MHC beta chain, and a highly charged intracellular sequence of 40 resides (Maddon, *Cell* 42:93, 1985).

The term "CD4" includes polypeptide molecules that are derived from CD4 include fragments of CD4, generated either by chemical (for example enzymatic) digestion or genetic engineering means. Such a fragment may be one or more entire CD4 protein domains. The extracellular domain of CD4 consists of four contiguous immunoglobulin-like regions (D1, D2, D3, and D4, see Sakihama et al., *Proc. Natl. Acad. Sci.* 92:6444, 1995; U.S. Pat. No. 6,117,655), and amino acids 1 to 183 have been shown to be involved in gp120 binding. For instance, a binding molecule or binding domain derived from CD4 would comprise a sufficient portion of the CD4 protein to mediate specific and functional interaction between the binding fragment and a native or viral binding site of CD4. One such binding fragment includes both the D1 and D2 extracellular domains of CD4 (D1D2 is also a fragment of soluble CD4 or sCD4 which is comprised of D1 D2 D3 and D4), although smaller fragments may also provide specific and functional CD4-like binding. The gp120-binding site has been mapped to D1 of CD4.

CD4 polypeptides also include "CD4-derived molecules" which encompasses analogs (non-protein organic molecules), derivatives (chemically functionalized protein molecules obtained starting with the disclosed protein sequences) or mimetics (three-dimensionally similar chemicals) of the native CD4 structure, as well as proteins sequence variants or genetic alleles that maintain the ability to functionally bind to a target molecule.

CD4BS antibodies: Antibodies that bind to or substantially overlap the CD4 binding surface of a gp120 polypeptide. The antibodies interfere with or prevent CD4 from binding to a gp120 polypeptide.

CD41 antibodies: Antibodies that bind to a conformation of gp120 induced by CD4 binding.

Chimeric antibody: An antibody which includes sequences derived from two different antibodies, which typically are of different species. In some examples, a chimeric antibody includes one or more CDRs and/or framework regions from one human antibody and CDRs and/or framework regions from another human antibody.

Contacting: Placement in direct physical association; includes both in solid and liquid form, which can take place either in vivo or in vitro. Contacting includes contact between one molecule and another molecule, for example the amino acid on the surface of one polypeptide, such as an antigen, that contacts another polypeptide, such as an antibody. Contacting can also include contacting a cell for example by placing an antibody in direct physical association with a cell.

Computer readable media: Any medium or media, which can be read and accessed directly by a computer, so that the media is suitable for use in a computer system. Such media include, but are not limited to: magnetic storage media such as floppy discs, hard disc storage medium and magnetic tape; optical storage media such as optical discs or CD-ROM; electrical storage media such as RAM and ROM; and hybrids of these categories such as magnetic/optical storage media.

Computer system: Hardware that can be used to analyze atomic coordinate data and/or design an antigen using atomic coordinate data. The minimum hardware of a computer-based system typically comprises a central processing unit (CPU), an input device, for example a mouse, keyboard, and the like, an output device, and a data storage device. Desirably a monitor is provided to visualize structure data. The data storage device may be RAM or other means for accessing computer readable. Examples of such systems are microcomputer workstations available from Silicon Graphics Incorporated and Sun Microsystems running Unix based Windows NT or IBM OS/2 operating systems.

Epitope: An antigenic determinant. These are particular chemical groups or peptide sequences on a molecule that are antigenic, i.e. that elicit a specific immune response. An antibody specifically binds a particular antigenic epitope on a polypeptide. In some examples a disclosed antibody specifically binds to an epitope on the surface of gp120 from HIV. In some examples a disclosed antibody specifically binds to an epitope on the surface of gp41 from HIV.

Epitope Scaffold: Refers to a heterologous protein that is engrafted with a foreign epitope of interest on its surface. Transplantation of the epitope is performed computationally in a manner that preserves its relevant structure and conformation. Mutations within the acceptor scaffold are made in order to accommodate the epitope graft. The graft can be modified to represent the sequences of different clades and strains.

Framework Region: Amino acid sequences interposed between CDRs. Includes variable light and variable heavy framework regions. The framework regions serve to hold the CDRs in an appropriate orientation for antigen binding.

Fc polypeptide: The polypeptide comprising the constant region of an antibody excluding the first constant region immunoglobulin domain. Fc region generally refers to the last two constant region immunoglobulin domains of IgA, IgD, and IgG, and the last three constant region immunoglobulin domains of IgE and IgM. An Fc region may also include part or all of the flexible hinge N-terminal to these domains. For IgA and IgM, an Fc region may or may not comprise the tailpiece, and may or may not be bound by the J chain. For IgG, the Fc region comprises immunoglobulin domains Cgamma2 and Cgamma3 (Cγ2 and Cγ3) and the lower part of the hinge between Cgamma1 (Cγ1) and Cγ2. Although the boundaries of the Fc region may vary, the human IgG heavy chain Fc region is usually defined to comprise residues C226 or P230 to its carboxyl-terminus, wherein the numbering is according to the EU index as in Kabat. For IgA, the Fc region comprises immunoglobulin domains Calpha2 and Calpha3 (Cα2 and Cα3) and the lower part of the hinge between Calpha1 (Cα1) and Cα2. Encompassed within the definition of the Fc region are functionally equivalent analogs and variants of the Fc region. A functionally equivalent analog of the Fc region may be a variant Fc region, comprising one or more amino acid modifications relative to the wild-type or naturally existing Fc region. Variant Fc regions will possess at least 50% homology with a naturally existing Fc region, such as about 80%, and about 90%, or at least about 95% homology. Functionally equivalent analogs of the Fc region may comprise one or more amino acid residues added to or deleted from the N- or C-termini of the protein, such as no more than 30 or no more than 10 additions and/or deletions. Functionally equivalent analogs of the Fc region include Fc regions operably linked to a fusion partner. Functionally equivalent analogs of the Fc region must comprise the majority of all of the Ig domains that compose Fc region as defined above; for example IgG and IgA Fc regions as defined herein must comprise the majority of the sequence encoding $CH_2$ and the majority of the sequence encoding $CH_3$. Thus, the $CH_2$ domain on its own, or the $CH_3$ domain on its own, are not considered Fc region. The Fc region may refer to this region in isolation, or this region in the context of an Fc fusion polypeptide (immunoadhesin, see below).

Furin: A calcium dependent serine endoprotease that cleaves precursor proteins at paired basic amino acid processing sites. In vivo, substrates of furin include proparathyroid hormone, proablumin, and von Willebrand factor. Furin can also cleave HIV envelope protein gp160 into gp120 and gp41. Furin cleaves proteins just downstream of a basic amino acid target sequence (canonically, Arg-X-(Arg/Lys)-Arg'). Thus, this amino acid sequence is a furin cleavage site.

gp41: A HIV protein that contains a transmembrane domain and remains in a trimeric configuration; it interacts with gp120 in a non-covalent manner. The envelope protein of HIV-1 is initially synthesized as a longer precursor protein of 845-870 amino acids in size, designated gp160. gp160 forms a homotrimer and undergoes glycosylation within the Golgi apparatus. In vivo, it is then cleaved by a cellular protease into gp120 and gp41. The amino acid sequence of an example of gp41 is set forth in GENBANK® Accession No. CAD20975 (as available on Oct. 16, 2009) which is incorporated by reference herein. It is understood that the sequence of gp41 can vary from that given in GENBANK® Accession No. CAD20975. gp41 contains a transmembrane domain and typically remains in a trimeric configuration; it interacts with gp120 in a non-covalent manner.

gp120: An envelope protein from Human Immunodeficiency Virus (HIV). This envelope protein is initially synthesized as a longer precursor protein of 845-870 amino acids in size, designated gp160. gp160 is cleaved by a cellular protease into gp120 and gp41. gp120 contains most of the external, surface-exposed, domains of the HIV envelope glycoprotein complex, and it is gp120 which binds both to cellular CD4 receptors and to cellular chemokine receptors (such as CCR5).

The mature gp120 wildtype polypeptides have about 500 amino acids in the primary sequence. gp120 is heavily N-glycosylated giving rise to an apparent molecular weight of 120 kD. The polypeptide is comprised of five conserved regions (C1-C5) and five regions of high variability (V1-V5). Exemplary sequence of wt gp120 polypeptides are shown on GENBANK®, for example accession numbers AAB05604 and AAD12142 (as available on Oct. 16, 2009), incorporated by reference herein. It is understood that there are numerous variation in the sequence of gp120 from what is given in GENBANK®, for example accession numbers AAB05604 and AAD12142, and that these variants are skill recognized in the art as gp120.

The gp120 core has a molecular structure, which includes two domains: an "inner" domain (which faces gp41) and an "outer" domain (which is mostly exposed on the surface of the oligomeric envelope glycoprotein complex). The two gp120 domains are separated by a "bridging sheet" that is not part of either domain. The gp120 core comprises 25 beta strands, 5 alpha helices, and 10 defined loop segments.

The third variable region referred to herein as the V3 loop is a loop of about 35 amino acids critical for the binding of the co-receptor and determination of which of the co-receptors will bind. In certain examples the V3 loop comprises residues 296-331.

The numbering used in gp120 polypeptides disclosed herein is relative to the HXB2 numbering scheme as set forth in *Numbering Positions in HIV Relative to HXB2CG* Bette Korber et al., Human Retroviruses and AIDS 1998: A Compilation and Analysis of Nucleic Acid and Amino Acid Sequences. Korber B, Kuiken C L, Foley B, Hahn B, McCutchan F, Mellors J W, and Sodroski J, Eds. Theoretical Biology and Biophysics Group, Los Alamos National Laboratory, Los Alamos, N. Mex. which is incorporated by reference herein in its entirety.

Host cells: Cells in which a vector can be propagated and its DNA expressed, for example a disclosed antibody can be expressed in a host cell. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Immunoadhesin: A molecular fusion of a protein with the Fc region of an immunoglobulin, wherein the immunogloblin retains specific properties, such as Fc receptor binding and increased half-life. An Fc fusion combines the Fc region of an immunoglobulin with a fusion partner, which in general can be any protein, polypeptide, peptide, or small molecule. In one example, and immunoadhesin includes the hinge, $CH_2$, and $CH_3$ domains of the immunoglobulin gamma 1 heavy chain constant region. In another example, the immunoadhesin includes the $CH_2$, and $CH_3$ domains of an IgG.

Immunological Probe: A molecule that can be used for selection of antibodies from sera which are directed against a specific epitope, including from human patient sera. The epitope scaffolds, along with related point mutants, can be used as immunological probes in both positive and negative selection of antibodies against the epitope graft. In some examples immunological probes are engineered variants of gp120.

Immunologically reactive conditions: Includes reference to conditions which allow an antibody raised against a particular epitope to bind to that epitope to a detectably greater degree than, and/or to the substantial exclusion of, binding to substantially all other epitopes. Immunologically reactive conditions are dependent upon the format of the antibody binding reaction and typically are those utilized in immunoassay protocols or those conditions encountered in vivo. See Harlow & Lane, supra, for a description of immunoassay formats and conditions. The immunologically reactive conditions employed in the methods are "physiological conditions" which include reference to conditions (e.g., temperature, osmolarity, pH) that are typical inside a living mammal or a mammalian cell. While it is recognized that some organs are subject to extreme conditions, the intra-organismal and intracellular environment normally lies around pH 7 (e.g., from pH 6.0 to pH 8.0, more typically pH 6.5 to 7.5), contains water as the predominant solvent, and exists at a temperature above 0° C. and below 50° C. Osmolarity is within the range that is supportive of cell viability and proliferation.

IgA: A polypeptide belonging to the class of antibodies that are substantially encoded by a recognized immunoglobulin alpha gene. In humans, this class or isotype comprises $IgA_1$ and $IgA_2$. IgA antibodies can exist as monomers, polymers (referred to as pIgA) of predominantly dimeric form, and secretory IgA. The constant chain of wild-type IgA contains an 18-amino-acid extension at its C-terminus called the tail piece (tp). Polymeric IgA is secreted by plasma cells with a 15-kDa peptide called the J chain linking two monomers of IgA through the conserved cysteine residue in the tail piece.

IgG: A polypeptide belonging to the class or isotype of antibodies that are substantially encoded by a recognized immunoglobulin gamma gene. In humans, this class comprises $IgG_1$, $IgG_2$, $IgG_3$, and $IgG_4$. In mice, this class comprises $IgG_1$, $IgG_{2a}$, $IgG_{2b}$, $IgG_3$.

Inhibiting or treating a disease: Inhibiting the full development of a disease or condition, for example, in a subject who is at risk for a disease such as acquired immunodeficiency syndrome (AIDS). "Treatment" refers to a therapeutic intervention that ameliorates a sign or symptom of a disease or pathological condition after it has begun to develop. The term "ameliorating," with reference to a disease or pathological condition, refers to any observable beneficial effect of the treatment. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters well known in the art that are specific to the particular disease. A "prophylactic" treatment is a treatment administered to a subject who does not exhibit signs of a disease or exhibits only early signs for the purpose of decreasing the risk of developing pathology.

Isolated: An "isolated" biological component (such as a cell, for example a Bcell, a nucleic acid, peptide, protein or antibody) has been substantially separated, produced apart from, or purified away from other biological components in the cell of the organism in which the component naturally occurs, such as, other chromosomal and extrachromosomal DNA and RNA, and proteins. Nucleic acids, peptides and proteins which have been "isolated" thus include nucleic acids and proteins purified by standard purification methods. The term also embraces nucleic acids, peptides, and proteins prepared by recombinant expression in a host cell as well as chemically synthesized nucleic acids. In some examples an antibody, such as an antibody specific for gp120 can be isolated, for example isolated from a subject infected with HIV.

In silico: A process performed virtually within a computer. For example, using a computer, a virtual compound can be screened for surface similarity or conversely surface complementarity to a virtual representation of the atomic positions at least a portion of a gp120 polypeptide, a gp120 polypeptide in complex with an antibody, a gp41 polypeptide, or a pg41 polypeptide in complex with an antibody.

$K_d$: The dissociation constant for a given interaction, such as a polypeptide ligand interaction or an antibody antigen interaction. For example, for the bimolecular interaction of an antibody (such as VRC01, VRC02, or VRC03) and an antigen (such as gp120) it is the concentration of the individual components of the bimolecular interaction divided by the concentration of the complex.

Label: A detectable compound or composition that is conjugated directly or indirectly to another molecule, such as an antibody or a protein, to facilitate detection of that molecule. Specific, non-limiting examples of labels include fluorescent tags, enzymatic linkages, and radioactive isotopes. In some examples, a disclosed antibody as labeled.

Neutralizing antibody: An antibody which reduces the infectious titer of an infectious agent by binding to a specific antigen on the infectious agent. In some examples the infectious agent is a virus. In some examples, an antibody that is specific for gp120 neutralizes the infectious titer of HIV.

Nucleic acid: A polymer composed of nucleotide units (ribonucleotides, deoxyribonucleotides, related naturally occurring structural variants, and synthetic non-naturally occurring analogs thereof) linked via phosphodiester bonds, related naturally occurring structural variants, and synthetic non-naturally occurring analogs thereof. Thus, the term includes nucleotide polymers in which the nucleotides and the linkages between them include non-naturally occurring synthetic analogs, such as, for example and without limitation, phosphorothioates, phosphoramidates, methyl phosphonates, chiral-methyl phosphonates, 2-O-methyl ribonucleotides, peptide-nucleic acids (PNAs), and the like. Such polynucleotides can be synthesized, for example, using an automated DNA synthesizer. The term "oligonucleotide" typically refers to short polynucleotides, generally no greater than about 50 nucleotides. It will be understood that when a nucleotide sequence is represented by a DNA sequence (i.e., A, T, G, C), this also includes an RNA sequence (i.e., A, U, G, C) in which "U" replaces "T."

Conventional notation is used herein to describe nucleotide sequences: the left-hand end of a single-stranded nucleotide sequence is the 5'-end; the left-hand direction of a double-stranded nucleotide sequence is referred to as the 5'-direction.

The direction of 5' to 3' addition of nucleotides to nascent RNA transcripts is referred to as the transcription direction. The DNA strand having the same sequence as an mRNA is referred to as the "coding strand;" sequences on the DNA strand having the same sequence as an mRNA transcribed from that DNA and which are located 5' to the 5'-end of the RNA transcript are referred to as "upstream sequences;" sequences on the DNA strand having the same sequence as the RNA and which are 3' to the 3' end of the coding RNA transcript are referred to as "downstream sequences."

"cDNA" refers to a DNA that is complementary or identical to an mRNA, in either single stranded or double stranded form.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA produced by that gene produces the protein in a cell or other biological system. Both the coding strand, the nucleotide sequence of which is identical to the mRNA sequence and is usually provided in sequence listings, and non-coding strand, used as the template for transcription, of a gene or cDNA can be referred to as encoding the protein or other product of that gene or cDNA. Unless otherwise specified, a "nucleotide sequence encoding an amino acid sequence" includes all nucleotide sequences that are degenerate versions of each other and that encode the same amino acid sequence. Nucleotide sequences that encode proteins and RNA may include introns.

"Recombinant nucleic acid" refers to a nucleic acid having nucleotide sequences that are not naturally joined together. This includes nucleic acid vectors comprising an amplified or assembled nucleic acid which can be used to transform a suitable host cell. A host cell that comprises the recombinant nucleic acid is referred to as a "recombinant host cell." The gene is then expressed in the recombinant host cell to produce, e.g., a "recombinant polypeptide." A recombinant nucleic acid may serve a non-coding function (e.g., promoter, origin of replication, ribosome-binding site, etc.) as well.

A first sequence is an "antisense" with respect to a second sequence if a polynucleotide whose sequence is the first sequence specifically hybridizes with a polynucleotide whose sequence is the second sequence.

Terms used to describe sequence relationships between two or more nucleotide sequences or amino acid sequences include "reference sequence," "selected from," "comparison window," "identical," "percentage of sequence identity," "substantially identical," "complementary," and "substantially complementary."

For sequence comparison of nucleic acid sequences, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters are used. Methods of alignment of sequences for comparison are well known in the art. Optimal alignment of sequences for comparison can be conducted, e.g., by the local homology algorithm of Smith & Waterman, *Adv. Appl. Math.* 2:482, 1981, by the homology alignment algorithm of Needleman & Wunsch, *J. Mol. Biol.* 48:443, 1970, by the search for similarity method of Pearson & Lipman, *Proc. Nat'l. Acad. Sci. USA* 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds 1995 supplement)).

One example of a useful algorithm is PILEUP. PILEUP uses a simplification of the progressive alignment method of Feng & Doolittle, *J. Mol. Evol.* 35:351-360, 1987. The method used is similar to the method described by Higgins & Sharp, *CABIOS* 5:151-153, 1989. Using PILEUP, a reference sequence is compared to other test sequences to determine the percent sequence identity relationship using the following parameters: default gap weight (3.00), default gap length weight (0.10), and weighted end gaps. PILEUP can be obtained from the GCG sequence analysis software package, e.g., version 7.0 (Devereaux et al., *Nuc. Acids Res.* 12:387-395, 1984.

Another example of algorithms that are suitable for determining percent sequence identity and sequence similarity are the BLAST and the BLAST 2.0 algorithm, which are described in Altschul et al., *J. Mol. Biol.* 215:403-410, 1990 and Altschul et al., *Nucleic Acids Res.* 25:3389-3402, 1977. Software for performing BLAST analyses is publicly available through the National Center for Biotechnology Information (ncbi.nlm.nih.gov). The BLASTN program (for nucleotide sequences) uses as defaults a word length (W) of 11, alignments (B) of 50, expectation (E) of 10, M=5, N=−4, and a comparison of both strands. The BLASTP program (for amino acid sequences) uses as defaults a word length (W) of 3, and expectation (E) of 10, and the BLOSUM62 scoring matrix (see Henikoff & Henikoff, *Proc. Natl. Acad. Sci. USA* 89:10915, 1989). An oligonucleotide is a linear polynucleotide sequence of up to about 100 nucleotide bases in length.

A polynucleotide or nucleic acid sequence refers to a polymeric form of nucleotide at least 10 bases in length. A recombinant polynucleotide includes a polynucleotide that is not immediately contiguous with both of the coding sequences with which it is immediately contiguous (one on the 5' end and one on the 3' end) in the naturally occurring genome of the organism from which it is derived. The term therefore includes, for example, a recombinant DNA which is incorporated into a vector; into an autonomously replicating plasmid or virus; or into the genomic DNA of a prokaryote or eukaryote, or which exists as a separate molecule (e.g., a cDNA) independent of other sequences. The nucleotides can be ribonucleotides, deoxyribonucleotides, or modified forms of either nucleotide. The term includes single- and double-stranded forms of DNA. A gp120 polynucleotide is a nucleic acid encoding a gp120 polypeptide.

Pharmaceutically acceptable carriers: The pharmaceutically acceptable carriers of use are conventional. *Remington's Pharmaceutical Sciences*, by E. W. Martin, Mack Publishing Co., Easton, Pa., 19th Edition, 1995, describes compositions and formulations suitable for pharmaceutical delivery of the antibodies herein disclosed.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Pharmaceutical agent: A chemical compound or composition capable of inducing a desired therapeutic or prophylactic effect when properly administered to a subject or a cell. In some examples a pharmaceutical agent includes one one or more of the disclosed antibodies.

Polypeptide: Any chain of amino acids, regardless of length or post-translational modification (e.g., glycosylation or phosphorylation). In one embodiment, the polypeptide is gp120 polypeptide. In another embodiment, the polypeptide is gp41 polypeptide. In one embodiment, the polypeptide is a disclosed antibody or a fragment thereof. A "residue" refers to an amino acid or amino acid mimetic incorporated in a polypeptide by an amide bond or amide bond mimetic. A polypeptide has an amino terminal (N-terminal) end and a carboxy terminal end.

Purified: The term purified does not require absolute purity; rather, it is intended as a relative term. Thus, for example, a purified peptide preparation is one in which the peptide or protein (such as an antibody) is more enriched than the peptide or protein is in its natural environment within a cell. In one embodiment, a preparation is purified such that the protein or peptide represents at least 50% of the total peptide or protein content of the preparation.

Recombinant: A recombinant nucleic acid is one that has a sequence that is not naturally occurring or has a sequence that is made by an artificial combination of two otherwise separated segments of sequence. This artificial combination is often accomplished by chemical synthesis or, more commonly, by the artificial manipulation of isolated segments of nucleic acids, e.g., by genetic engineering techniques.

Sequence identity: The similarity between amino acid sequences is expressed in terms of the similarity between the sequences, otherwise referred to as sequence identity. Sequence identity is frequently measured in terms of percentage identity (or similarity or homology); the higher the percentage, the more similar the two sequences are. Homologs or variants of a polypeptide will possess a relatively high degree of sequence identity when aligned using standard methods.

Methods of alignment of sequences for comparison are well known in the art. Various programs and alignment algorithms are described in: Smith and Waterman, *Adv. Appl. Math.* 2:482, 1981; Needleman and Wunsch, *J. Mol. Biol.* 48:443, 1970; Pearson and Lipman, *Proc. Natl. Acad. Sci. U.S.A.* 85:2444, 1988; Higgins and Sharp, *Gene* 73:237, 1988; Higgins and Sharp, *CABIOS* 5:151, 1989; Corpet et al., *Nucleic Acids Research* 16:10881, 1988; and Pearson and Lipman, *Proc. Natl. Acad. Sci. U.S.A.* 85:2444, 1988. Altschul et al., *Nature Genet.* 6:119, 1994, presents a detailed consideration of sequence alignment methods and homology calculations.

The NCBI Basic Local Alignment Search Tool (BLAST) (Altschul et al., *J. Mol. Biol.* 215:403, 1990) is available from several sources, including the National Center for Biotechnology Information (NCBI, Bethesda, Md.) and on the internet, for use in connection with the sequence analysis programs blastp, blastn, blastx, tblastn and tblastx. A description of how to determine sequence identity using this program is available on the NCBI website on the internet.

Homologs and variants of a $V_L$ or a $V_H$ of an antibody that specifically binds a polypeptide are typically characterized by possession of at least about 75%, for example at least about 80%, 85%, 90%, 91%, 92%, 93%, 94%, 95%, 96%, 97%, 98% or 99% sequence identity counted over the full length alignment with the amino acid sequence of interest. Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

Specifically bind: When referring to an antibody, refers to a binding reaction which determines the presence of a target protein, peptide, or polysaccharide in the presence of a heterogeneous population of proteins and other biologics. Thus, under designated conditions, an antibody binds preferentially to a particular target protein, peptide or polysaccharide (such as an antigen present on the surface of a pathogen, for example gp120) and do not bind in a significant amount to other proteins or polysaccharides present in the sample or subject. Specific binding can be determined by methods known in the art. With reference to an antibody antigen complex, specific binding of the antigen and antibody has a $K_d$ of less than about $10^{-6}$ Molar, such as less than about $10^{-6}$ Molar, $10^{-7}$ Molar, $10^{-8}$ Molar, $10^{-9}$, or even less than about $10^{-10}$ Molar.

Therapeutic agent: Used in a generic sense, it includes treating agents, prophylactic agents, and replacement agents.

Therapeutically effective amount: A quantity of a specific substance, such as a disclosed antibody, sufficient to achieve a desired effect in a subject being treated. For instance, this can be the amount necessary to inhibit HIV replication or treat AIDS. In several embodiments, a therapeutically effective amount is the amount necessary to reduce a sign or symptom of AIDS, and/or to decrease viral titer in a subject. When administered to a subject, a dosage will generally be used that will achieve target tissue concentrations that has been shown to achieve a desired in vitro effect.

T Cell: A white blood cell critical to the immune response. T cells include, but are not limited to, $CD4^+$ T cells and $CD8^+$ T cells. A $CD4^+$ T lymphocyte is an immune cell that carries a marker on its surface known as "cluster of differentiation 4" (CD4). These cells, also known as helper T cells, help orchestrate the immune response, including antibody responses as well as killer T cell responses. $CD8^+$ T cells carry the "cluster of differentiation 8" (CD8) marker. In one embodiment, a CD8 T cells is a cytotoxic T lymphocytes. In another embodiment, a CD8 cell is a suppressor T cell.

Vector: A nucleic acid molecule as introduced into a host cell, thereby producing a transformed host cell. A vector may include nucleic acid sequences that permit it to replicate in a host cell, such as an origin of replication. A vector may also include one or more selectable marker genes and other genetic elements known in the art.

Virus: Microscopic infectious organism that reproduces inside living cells. A virus consists essentially of a core of a single nucleic acid surrounded by a protein coat, and has the ability to replicate only inside a living cell. "Viral replication" is the production of additional virus by the occurrence of at least one viral life cycle. A virus may subvert the host cells' normal functions, causing the cell to behave in a manner determined by the virus. For example, a viral infection may result in a cell producing a cytokine, or responding to a cytokine, when the uninfected cell does not normally do so.

"Retroviruses" are RNA viruses wherein the viral genome is RNA. When a host cell is infected with a retrovirus, the genomic RNA is reverse transcribed into a DNA intermediate which is integrated very efficiently into the chromosomal DNA of infected cells. The integrated DNA intermediate is referred to as a provirus. The term "lentivirus" is used in its conventional sense to describe a genus of viruses containing reverse transcriptase. The lentiviruses include the "immunodeficiency viruses" which include human immunodeficiency virus (HIV) type 1 and type 2 (HIV-I and HIV-II), simian immunodeficiency virus (SIV), and feline immunodeficiency virus (FIV).

HIV-I is a retrovirus that causes immunosuppression in humans (HIV disease), and leads to a disease complex known as the acquired immunodeficiency syndrome (AIDS). "HIV disease" refers to a well-recognized constellation of signs and symptoms (including the development of opportunistic infections) in persons who are infected by an HIV virus, as determined by antibody or western blot studies. Laboratory findings associated with this disease are a progressive decline in T cells.

II. Description of Several Embodiments

A. Neutralizing Monoclonal Antibodies

Isolated human monoclonal antibodies that specifically bind gp120 or gp41 are disclosed herein. Also disclosed herein are compositions including these human monoclonal antibodies and a pharmaceutically acceptable carrier. Nucleic acids encoding these antibodies, expression vectors comprising these nucleic acids, and isolated host cells that express the nucleic acids are also provided.

Compositions comprising the human monoclonal antibodies specific for gp120 or gp41 can be used for research, diagnostic and therapeutic purposes. For example, the human monoclonal antibodies disclosed herein can be used to diagnose or treat a subject having an HIV-1 infection and/or AIDS. For example, the antibodies can be used to determine HIV-1 titer in a subject. The antibodies disclosed herein also can be used to study the biology of the human immunodeficiency virus.

In some embodiments, the isolated human monoclonal antibody specifically binds gp120, and includes a heavy chain with amino acids 26-33 (CDR1), 51-58 (CDR2), and 97-110 (CDR3) of SEQ ID NO: 1. In specific examples, the heavy chain of the human monoclonal antibody includes SEQ ID NO: 1. In additional examples, the heavy chain of the monoclonal antibody includes SEQ ID NO: 3. In another example, the isolated human monoclonal antibody specifically binds gp120, and includes a heavy chain with amino acids 26-33 (CDR1), 51-58 (CDR2), and 97-110 (CDR3) of SEQ ID NO: 1 and the light chain of the antibody includes amino acids 27-30 (CDR1), 48-50 (CDR2), and 87-91 (CDR3) of SEQ ID NO: 2. In additional embodiments, the isolated human monoclonal antibody specifically binds gp120 and the light chain of the antibody includes amino acids 27-30 (CDR1), 48-50 (CDR2), and 87-91 (CDR3) of SEQ ID NO: 2. In specific examples, the light chain of the antibody includes SEQ ID NO: 2. In additional examples, the light chain of the antibody includes SEQ ID NO: 4.

In further embodiments, the isolated human monoclonal antibody specifically binds gp120, and includes a heavy chain with at most one, at most two, at most three or at most four amino acid substitutions in amino acids 26-33 (CDR1), 51-58 (CDR2), and 97-110 (CDR3) of SEQ ID NO: 1, and a light chain. In some embodiments, the antibody can include a heavy chain with at most one, at most two, at most three or at most four amino acid substitutions in amino acids in 26-33 (CDR1), 51-58 (CDR2), and 97-110 (CDR3) of SEQ ID NO: 1, and can include a light chain that includes amino acids 27-30 (CDR1), 48-50 (CDR2), and 87-91 (CDR3) of SEQ ID NO: 2. In some embodiments, the antibody can include a heavy chain with at most one, at most two, at most three or at most four amino acid substitutions amino acids in 26-33 (CDR1), 51-58 (CDR2), and 97-110 (CDR3) of SEQ ID NO: 1, and can include a light chain with at most one, at most two, at most three or at most four amino acid substitutions in amino acids 27-30 (CDR1), 48-50 (CDR2), and 87-91 (CDR3) of SEQ ID NO: 2.

The antibody can include a heavy chain with at most one, at most two, at most three or at most four amino acid substitutions amino acids in 26-33 (CDR1), 51-58 (CDR2), and 97-110 (CDR3) of SEQ ID NO: 1 and a light chain that can include SEQ ID NO: 2 or SEQ ID NO: 4. In some examples, these antibodies retain the binding affinity of the parental antibody (VRC01 or VRC02) for the antigenic epitope. Thus, in some examples, these antibodies have a KD of <3 nM for the antigenic epitope of gp120.

In another set of embodiments, the isolated human monoclonal antibody specifically binds gp120, and the light chain of the antibody includes at most one, at most two, at most three or at most four substitutions in amino acids 27-30 (CDR1), 48-50 (CDR2), and 87-91 (CDR3) of SEQ ID NO: 2. It should be noted that no more than three substitutions can be made in CDR2. The isolated monoclonal antibody can include a heavy chain that includes amino acids 26-33 (CDR1), 51-58 (CDR2), and 97-110 (CDR3) of SEQ ID NO: 1 and the light chain of the antibody can include at most one, at most two, at most three or at most four substitutions in amino acids 27-30 (CDR1), 48-50 (CDR2), and 87-91 (CDR3) of SEQ ID NO: 2. It should be noted that no more than three substitutions can be made in CDR2. The antibody can include a heavy chain including the amino acid sequence set forth as SEQ ID NO: 1 or SEQ ID NO: 3, and a light chain that includes SEQ ID NO: 2 with at most one, at most two, at most three or at most four substitutions in amino acids 27-30 (CDR1), 48-50 (CDR2), and 87-91 (CDR3) of SEQ ID NO: 2. It should be noted that no more than three substitutions can be made in CDR2. In some examples, these antibodies retain the binding affinity of the parental antibody (VRC01 or VRC02) for the antigenic epitope. Thus, in some examples, these antibodies have a $K_D$ of <3 nM for the antigenic epitope of gp120.

In some embodiments, the isolated human monoclonal antibody specifically binds gp120, and includes a heavy chain with amino acids 26-35 (CDR1), 50-66 (CDR2), and 106-119 (CDR3) of SEQ ID NO: 27. In specific examples, the heavy chain of the human monoclonal antibody includes SEQ ID NO: 27. In another example, the isolated human monoclonal antibody specifically binds gp120, and includes a heavy chain with amino acids 26-35 (CDR1), 50-66 (CDR2), and 106-119 (CDR3) of SEQ ID NO: 27 and a light chain that includes amino acids 24-33 (CDR1), 49-55 (CDR2), and 88-92 (CDR3) of SEQ ID NO: 28.

In further embodiments, the isolated human monoclonal antibody specifically binds gp120, and includes a heavy chain with at most one, at most two, at most three or at most four amino acid substitutions in amino acids 26-35 (CDR1), 50-66 (CDR2), and 106-119 (CDR3) of SEQ ID NO: 27, and a light chain. The antibody can include a heavy chain with at most one, at most two, at most three or at most four amino substitutions amino acids in 26-35 (CDR1), 50-66 (CDR2), and 106-119 (CDR3) of SEQ ID NO: 27, and a light chain that includes amino acids 24-33 (CDR1), 49-55 (CDR2), and 88-92 (CDR3) of SEQ ID NO: 28. The antibody can include a heavy chain with at most one, at most two, at most three or at most four amino acid substitutions amino acids in 26-35 (CDR1), 50-66 (CDR2), and 106-119 (CDR3) of SEQ ID NO: 27 and the light chain of the antibody can include SEQ ID NO: 28. In some examples, these antibodies retain the binding affinity of the parental antibody (VRC03) for the antigenic epitope.

In another set of embodiments, the isolated human monoclonal antibody specifically binds gp120, and the light chain of the antibody includes at most one, at most two, at most three or at most four substitutions in amino acids 24-33 (CDR1), 49-55 (CDR2), and 88-92 (CDR3) of SEQ ID NO: 28. The isolated monoclonal antibody can include a heavy chain that includes 26-35 (CDR1), 50-66 (CDR2), and 106-119 (CDR3) of SEQ ID NO: 27 and a light chain that include at most one, at most two, at most three or at most four substitutions in amino acids 24-33 (CDR1), 49-55 (CDR2), and 88-92 (CDR3) of SEQ ID NO: 28. The antibody can include a heavy chain including the amino acid sequence set forth as SEQ ID NO: 27, and a light chain that includes at most one, at most two, at most three or at most four substitutions in amino acids 24-33 (CDR1), 49-55 (CDR2), and 88-92 (CDR3) of SEQ ID NO: 28. In some examples, these antibodies retain the binding affinity of the parental antibody (VRC03) for the antigenic epitope. In additional embodiments, the isolated human monoclonal antibody specifically binds gp120 and the light chain of the antibody includes amino acids 24-33 (CDR1), 49-55 (CDR2), and 88-92 (CDR3) of SEQ ID NO: 28. In specific examples, the light chain of the antibody includes SEQ ID NO: 28.

In some embodiments, the isolated human monoclonal antibody specifically binds gp120, and includes a heavy chain with CDR1, CDR2, and CDR3 of any one of SEQ ID NOs: 760-1459. In specific examples, the heavy chain of the human monoclonal antibody includes any one of SEQ ID NOs: 760-1459. In some embodiments, the isolated human monoclonal antibody specifically binds gp120, and includes a heavy chain with CDR1, CDR2, and CDR3 of SEQ ID NO: 1316. In specific examples, the heavy chain of the human monoclonal antibody includes the amino acids set forth as SEQ ID NO: 1316.

VRC01 and VRC03-like antibodies share unique binding site on the surface of gp120. Thus, in some embodiments, the antibody specifically binds to an epitope on the surface of gp120 that includes, residues 276, 278-283, 365-368, 371, 455-459, 461, 469, and 472-474 of gp120 or a subset or combination thereof (see FIGs. see FIGS. 83-91 and 93-97, the numbering of gp120 according to the HXBC2 convention is shown in FIG. 91). With reference to FIG. 91. VRC01 and VRC0-like antibodies bind to the epitope defined by residues $N_{276}.T_{278}NNAKT_{283} \ldots S_{365}GGD_{368} \ldots I_{371} \ldots T_{455}RDGG_{459}.N_{461} \ldots R_{469} \ldots G_{472}GN_{474}$ in gp120, which correspond to amino acid positions 169, 171-176, 229-232, 235, 319-323, 325, 333, 336-338 in SEQ ID NO: 45. The heavy chain of a VRC01 or VRC03-like antibody can be complemented by the light chain of VRC01, VRC02 and/or VRC03 and still retain binding for gp120, for example retain specific binding for residues 276, 278-283, 365-368, 371, 455-459, 461, 469, and 472-474 of gp120 (see FIGS. 83-91 and 93-97). Thus, in some embodiments, a disclosed antibody includes the heavy chain CDRs from any one of SEQ ID NOs: 1, 3, 27, and 760-1459 and a light chain from any one of SEQ ID NOs: 2, 4, and 28 and wherein the antibody specifically binds to residues 276, 278-283, 365-368, 371, 455-459, 461, 469, and 472-474 of gp120. In some embodiments, a disclosed antibody includes the heavy chain set forth as any one of SEQ ID NOs: 1, 3, 27, and 760-1459 and a light chain set forth as any one of SEQ ID NOs: 2, 4, and 28 and wherein the antibody specifically binds to residues 276, 278-283, 365-368, 371, 455-459, 461, 469 and 472-474 of gp120.

HIV-1 resists neutralization by most antibodies. However, the antibody VRC01, disclosed herein, successfully neutralizes over 90% of current circulating HIV-1 isolates. Another antibody disclosed herein, VRC03, successfully neutralizes over 50% of current circulating HIV-1 isolates. Antibodies VRC01 and VRC03 share only about 50% sequence identity in their variable domains, and there are a number of differences in their activity, including differential induction of antibody 17b binding and CCR5 recognition (VRC01 induces these, whereas VRC03 does not). Nonetheless, crystal structures of VRC01 and VRC03 show virtual identical arrangements of heavy chain and light chain recognition of HIV-1 gp120. The similar recognition by VRC01 and VRC03 antibodies of gp120 indicate that they are members of a class of antibodies, are able to recognize and to neutralize HIV-1 through a similar mode of binding. Thus, these two antibodies, along with the third antibody VRC02 are representative members of a class of antibodies known as VRC01-like antibodies. Thus, disclosed herein are VRC01-like antibodies. While VRC01, VRC02 and VRC03 are representative members of this class of antibodies, using 454 sequencing, 700 additional VRC01 and VRC03-like antibodies have been identified. SEQ ID NOs: 60-759 are nucleic acid sequences encoding the heavy chains of VRC01 and VRC03 like antibodies. SEQ ID NOs: 760-1459 are amino acid sequences the heavy chains of VRC01 and VRC03 like antibodies.

The heavy and light chains of VRC01 and VRC03 can be swapped for partial complementation. For example, the VRC01 light chain and VRC03 heavy chain form active antibodies able to recognize HIV-1. In addition the VRC01 heavy chain and VRC03 light chain form active antibodies that recognize HIV-1. Thus, disclosed herein are VCR01-like antibodies that can be identified by complementation of the heavy or light chains of VCR01 and VCR03. For example, using complementation, the heavy chain amino acid sequences of SEQ ID NOs: 760-1459 are demonstrated to be VRC01 and VRC03-like antibodies that specifically bind gp120. Analysis of these antibodies found a number of sequences, of less than 75% to either VRC01 or VRC03 antibodies, which bioinformatics analysis indicate recognize and neutralize HIV-1. Thus, disclosed herein is a class of antibodies, VRC01-like antibodies, that recognize and neutralize HIV-1. Deep sequencing of heavy chains related to VRC01 in HIV-1 infected individuals with high CD4-binding-site antibody titers reveles sequences, for which bioinformatics analysis enables quick identification of those which can bind and neutralize HIV-1, for example as a way to facilitate antibody discovery. In some embodiments, the VRC01 and VRC03-like antibodies, and other VRC01-like antibodies compete with CD4 for binding to gp120.

As disclosed herein, deep sequencing results define the variation allowed for VRC01-like recognition, and relating this to germ-line VH sequences, which delineated maturation pathways to elicit additional neutralizing antibodies that bind to substantially similar epitopes on the surface of gp120 in substantially the same orientation that VRC01, VRC02 and/ or VRC03 bind. Thus a method is disclosed herein to determine if antibodies are in the same class specifically ising complementation of antibody H/L for function. For example, if chimeras of one antibody heavy chain with another's light chain (and vice-versa) allows for preservation of binding and neutralization, those two antibodies bind/function in the same mode and thus are members of the same class. Thus, any antibody that preserves antigen binding or HIV neutralization function by chain complementation with VRC01, VRC02 and/or VRC03 is considered a VRC01-like antibody.

The present disclosure also relates to the crystals obtained from the VRC03 or VRC01 antibody or portions thereof in complex with gp120, the crystal structures of the VRC03 or VRC01 antibody or portions thereof in complex with gp120, the three-dimensional coordinates of the VRC03 or VRC01 antibody or portions thereof in complex with gp120 and three-dimensional structures of models of the VRC03 or VRC01 antibody or portions thereof in complex with gp120. The three dimensional coordinates of VRC01 in complex with gp120 are available at the Protein Data Bank, at accession number 3NGB, and are incorporated herein by reference in their entirety as available Jul. 7, 2010. The three dimensional coordinates of VRC03 in complex with gp120 are given in Table 1 of Provisional Application No. 61/402,314, filed Aug. 27, 2010, and are incorporated herein by reference in their entirety.

The crystal structure of the VRC03 or the VRC01 antibody in complex with gp120 provides insight for a novel binding mode for antibodies and gp120. Such a novel binding mode establishes a new class of antibody recognition for gp120 that is indicative of a novel class of gp120 antibodies, as exemplified by VRC01, VRC02 and VRC03. Such antibodies are termed VRC01-like antibodies. In certain embodiments a VRC01-like antibody has a relative angle and orientation of binding of gp120 as shown in the crystal structure of the complex of the VRCR03 antibody and gp120 (see FIG. 2d of Zhou et al., "Structural Basis for Broad and Potent Neutralization of HIV-1 by Antibody VRC01, Science 329, 811-817 (2010), which is incorporated herein by reference in its entirety). In some examples, the VRC01-like antibodies partially mimic the binding of the CD4 receptor, with an about 6 Å shift and an about 43 degree rotation from the CD4-defined position (see FIG. 2d of Zhou et al., "Structural Basis for Broad and Potent Neutralization of HIV-1 by Antibody VRC01, Science 329, 811-817 (2010), which is incorporated herein by reference in its entirety), such as about a 45 degree rotation from the CD4-defined binding, for example about a 40 degree rotation, about a 50 degree rotation, about a 35 degree rotation or about a 55 degree rotation. In some examples, a VRC01-like antibody is an antibody with heavy and light chain in an orientation of heavy chain relative to gp120, that differs by less than 10 about degrees, such as less than about 9 about degrees, less than about 8 about degrees, less than about 7 about degrees, less than about 6 about degrees, less than about 5 about degrees, or less than about 4 degrees and/or less than about a 5 Å translation from the binding angle of VRC01 and/or VRC03 to gp120, such as less than about a 5 Å translation, such as less than about a 4 Å translation, than about a 3 Å translation, less than about a 2 Å translation, or less than about a 2 Å translation. Such a binding characteristic can readily be determined from the crystal structure of the VRC03 or VRC01 antibody complex.

Those of skill in the art will understand that a set of structure coordinates for the VRC01 or VRC03 antibody or portions thereof in complex with gp120 or a portion thereof, is a relative set of points that define a shape in three dimensions. Thus, it is possible that an entirely different set of coordinates could define a similar or identical shape. Moreover, slight variations in the individual coordinates will have little effect on overall shape. The variations in coordinates discussed above may be generated because of mathematical manipulations of the structure coordinates.

This disclosure further provides systems, such as computer systems, intended to generate structures and/or perform rational drug or compound design for an antigenic compound capable of eliciting an immune response in a subject. The system can contain one or more or all of: atomic co-ordinate data according to VRC03 or VRC01 antibody complex or a subset thereof, and the figures derived therefrom by homology modeling, the data defining the three-dimensional structure of a VRC03 or VRC01 antibody complex or at least one sub-domain thereof, or structure factor data for gp120, the structure factor data being derivable from the atomic co-ordinate data of VRC03 or VRC01 antibody complex or a subset thereof and the figures.

In some embodiments the CDR H2 region (the C" strand in particular) forms hydrogen-bonds to the b-15 loop of gp120. In some embodiments Asp 368 of gp120 forms a salt-bridge with Arg 71 of the heavy chain. All VRC01-like antibodies need to mimic CD4 with similar heavy chain orientations.

In some embodiments, the human monoclonal antibody specifically binds gp41. Thus, antibodies are provided herein wherein the heavy chain of the antibody comprises SEQ ID NO: 5 wherein one or more of amino acids 106, 107, or 109 of SEQ ID NO: 5 are substituted with a tryptophan. In one example, only amino acid 106 of SEQ ID NO: 5 is substituted with a tryptophan. In another example, only amino acid 107 is substituted for a tryptophan. In an additional example, amino acids 106 and 109 are substituted with a tryptophan. In some embodiments, the human monoclonal antibody comprises the heavy chain amino acid sequence set forth as SEQ ID NOs: 6, 7, 8 or 9.

In a further example, the human monoclonal antibody specifically binds gp41, and includes a heavy chain comprising the amino acid sequence set forth as SEQ ID NO: 5 wherein one or more of amino acids 106, 107, or 109 of SEQ ID NO: 5 are substituted with a tryptophan, and includes a light chain that includes the amino acid sequence set forth as SEQ ID NO: 10.

The heavy and the light chain are selected so that the antibody specifically binds either gp120 or gp41. In one example, the antibody specifically binds gp120 and includes the CDRs of the heavy chain amino acid sequence set forth as one of SEQ ID NO: 1, SEQ ID NO: 3 or SEQ ID NO: 27 or any one of SEQ ID NOs: 760-1459 and the CDRs of the light chain amino acid sequence set forth as one of SEQ ID NO: 2, SEQ ID NO: 4 or SEQ ID NO: 28. Thus, the antibody can specifically bind gp120 and includes the heavy chain amino acid sequence set forth as one of SEQ ID NO: 1, SEQ ID NO: 3 or SEQ ID NO: 27 or any one of SEQ ID NOs: 760-1459, and the light chain amino acid sequence set forth as one of SEQ ID NO: 2, SEQ ID NO: 4 or SEQ ID NO: 28.

In another example, the antibody specifically binds gp41. Thus, the antibody can include the CDRs of the heavy chain amino acid sequence set forth as one of SEQ ID NO: 6-9 and the CDRs of the light chain amino acid sequence set forth as one of SEQ ID NO: 10. The antibody can include the heavy chain amino acid sequence set forth as one of SEQ ID NOs: 6-9 and the light chain amino acid sequence set forth as SEQ ID NO: 10.

Fully human monoclonal antibodies include human framework regions. Thus, any of the antibodies that specifically bind gp120 or gp41 herein can include the human framework region and can include the framework regions of the amino acid sequence set forth in one of SEQ ID NOs: 1-10, 27 and 28. However, the framework regions can be from another source. Additional examples of framework sequences that can be used include the amino acid framework sequences of the heavy and light chains disclosed in PCT Publication No. WO 2006/074071 (see, for example, SEQ ID NOs: 1-16), which is herein incorporated by reference.

The monoclonal antibody can be of any isotype. The monoclonal antibody can be, for example, an IgM or an IgG antibody, such as $IgG_1$ or an $IgG_2$. The class of an antibody that specifically binds gp120 or gp41 can be switched with another. In one aspect, a nucleic acid molecule encoding $V_L$ or $V_H$ is isolated using methods well-known in the art, such that it does not include any nucleic acid sequences encoding the constant region of the light or heavy chain, respectively.

In particular examples, the $V_H$ amino acid sequence is SEQ ID NOs: 1, 3, 5, 6, 7, 8, 9, 27 or any one of 760-1459. In other examples, the $V_L$ amino acid sequence is SEQ ID NOs: 2, 4, 6, 10 or 28. In further examples, the $V_H$ nucleic acid sequence is SEQ ID NOs: 29, 31 or 33. In other examples, the $V_L$ nucleic acid sequence is SEQ ID NOs: 30, 32 or 34. The nucleic acid molecule encoding $V_L$ or $V_H$ is then operatively linked to a nucleic acid sequence encoding a $C_L$ or $C_H$ from a different class of immunoglobulin molecule. This can be achieved using a vector or nucleic acid molecule that comprises a $C_L$ or $C_H$ chain, as known in the art. For example, an antibody that specifically binds gp120, such as VRC01, VRC02 or VRC03, that was originally IgM may be class switched to an IgG. Similar class switches can also be achieved with an antibody that specifically binds gp41, such as 2F5, or any of its variants described herein. Class switching can be used to convert one IgG subclass to another, such as from IgG1 to $IgG_2$.

In some examples, the disclosed and antibodies are oligomers of antibodies, such as dimers trimers, tetramers, pentamers, hexamers, septamers, octomers and so on. In some examples, the antibodies are pentamers, for example pentamers of VRC01, VRC03, VRC02, or VRC01 and VRC03 like antibodies. Is a specific example the antibody is a a pentameric IgM antibody carrying the VRC01 V region (see e.g. FIG. 92).

By definition, the CDRs of the light chain are bounded by the residues at positions 24 and 34 (L-CDR1), 50 and 56 (L-CDR2), 89 and 97 (L-CDR3); the CDRs of the heavy chain are bounded by the residues at positions 31 and 35b (H-CDR1), 50 and 65 (H-CDR2), 95 and 102 (H-CDR3), using the numbering convention delineated by Kabat et al., (1991) *Sequences of Proteins of Immunological Interest, 5th* Edition, U.S. Department of Health and Human Services, Public Health Service, National Institutes of Health, Bethesda, Md. (NIH Publication No. 91-3242, which is specifically incorporated herein by reference in its entirety).

Antibody fragments are encompassed by the present disclosure, such as Fab, F(ab')$_2$, and Fv which include a heavy chain and light chain variable region and specifically bind gp120 or gp41. These antibody fragments retain the ability to selectively bind with the antigen. These fragments include:

(1) Fab, the fragment which contains a monovalent antigen-binding fragment of an antibody molecule, can be produced by digestion of whole antibody with the enzyme papain to yield an intact light chain and a portion of one heavy chain;

(2) Fab', the fragment of an antibody molecule can be obtained by treating whole antibody with pepsin, followed by reduction, to yield an intact light chain and a portion of the heavy chain; two Fab' fragments are obtained per antibody molecule;

(3) (Fab')$_2$, the fragment of the antibody that can be obtained by treating whole antibody with the enzyme pepsin without subsequent reduction; F(ab')$_2$ is a dimer of two Fab' fragments held together by two disulfide bonds;

(4) Fv, a genetically engineered fragment containing the variable region of the light chain and the variable region of the heavy chain expressed as two chains; and (5) Single chain antibody (such as scFv), defined as a genetically engineered molecule containing the variable region of the light chain, the variable region of the heavy chain, linked by a suitable polypeptide linker as a genetically fused single chain molecule.

(6) A dimer of a single chain antibody (scFV$_2$), defined as a dimer of a scFV. This has also been termed a "minantibody."

Methods of making these fragments are known in the art (see for example, Harlow and Lane, *Antibodies: A Laboratory Manual*, Cold Spring Harbor Laboratory, New York, 1988). In several examples, the variable region included in the antibody is the variable region of m912.

In a further group of embodiments, the antibodies are Fv antibodies, which are typically about 25 kDa and contain a complete antigen-binding site with three CDRs per each heavy chain and each light chain. To produce these antibodies, the $V_H$ and the $V_L$ can be expressed from two individual nucleic acid constructs in a host cell. In particular examples, the $V_H$ amino acid sequence includes the CDRs from one of SEQ ID NOs: 1, 3, 5, 6, 7, 8, 9 or 27, or any one of 760-1459. In other examples, the $V_L$ amino acid sequence includes the CDRs from SEQ ID NOs: 2, 4, 6 or 28. In additional examples, the $V_H$ amino acid sequence includes the amino acid sequence set forth as one of SEQ ID NOs: 1, 3, 5, 6, 7, 8, 9 or 27, or any one of 760-1459. In other examples, the $V_L$ amino acid sequence includes the amino acid sequence set forth as SEQ ID NOs: 2, 4, 6 or 28. In further examples, the $V_H$ nucleic acid sequence is SEQ ID NOs: 29, 31 or 33. In other examples, the $V_L$ nucleic acid sequence is SEQ ID NOs: 30, 32 or 34.

If the $V_H$ and the $V_L$ are expressed non-contiguously, the chains of the Fv antibody are typically held together by non-covalent interactions. However, these chains tend to dissociate upon dilution, so methods have been developed to crosslink the chains through glutaraldehyde, intermolecular disulfides, or a peptide linker Thus, in one example, the Fv can be a disulfide stabilized Fv (dsFv), wherein the heavy chain variable region and the light chain variable region are chemically linked by disulfide bonds.

In an additional example, the Fv fragments comprise $V_H$ and $V_L$ chains connected by a peptide linker These single-chain antigen binding proteins (scFv) are prepared by constructing a structural gene comprising DNA sequences encoding the $V_H$ and $V_L$ domains connected by an oligonucleotide. The structural gene is inserted into an expression vector, which is subsequently introduced into a host cell such as *E. coli*. The recombinant host cells synthesize a single polypeptide chain with a linker peptide bridging the two V domains. Methods for producing scFvs are known in the art (see Whitlow et al., *Methods: a Companion to Methods in Enzymology*, Vol. 2, page 97, 1991; Bird et al., *Science* 242: 423, 1988; U.S. Pat. No. 4,946,778; Pack et al., *Bio/Technology* 11:1271, 1993; and Sandhu, supra). Dimers of a single chain antibody (scFV$_2$), are also contemplated.

Antibody fragments can be prepared by proteolytic hydrolysis of the antibody or by expression in *E. coli* of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')$_2$. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly (see U.S. Pat. No. 4,036,945 and U.S. Pat. No. 4,331,647, and references contained therein; Nisonhoff et al., *Arch. Biochem. Biophys.* 89:230, 1960; Porter, *Biochem. J.* 73:119, 1959; Edelman et al., *Methods in Enzymology*, Vol. 1, page 422, Academic Press, 1967; and Coligan et al. at sections 2.8.1-2.8.10 and 2.10.1-2.10.4).

Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

One of skill will realize that conservative variants of the antibodies can be produced. Such conservative variants employed in antibody fragments, such as dsFv fragments or in scFv fragments, will retain critical amino acid residues necessary for correct folding and stabilizing between the $V_H$ and the $V_L$ regions, and will retain the charge characteristics of the residues in order to preserve the low pI and low toxicity of the molecules. Amino acid substitutions (such as at most one, at most two, at most three, at most four, or at most five amino acid substitutions) can be made in the $V_H$ and the $V_L$ regions to increase yield. In particular examples, the $V_H$ sequence is SEQ ID NOs: 1, 3, 5, 6, 7, 8, 9, 27 or any one of SEQ ID NOs: 760-1459. In other examples, the $V_L$ sequence is SEQ ID NOs: 2, 4, 6 or 28. Conservative amino acid substitution tables providing functionally similar amino acids are well known to one of ordinary skill in the art. The following six groups are examples of amino acids that are considered to be conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

The antibodies disclosed herein can be isolated using cloaked antigens, as described in PCT Publication No. WO 2009/100376. Briefly, antigens are cloaked to target antigenicity of the antigen to a specific epitope that specifically bound by the antibody of interest, such as a neutralizing antibody.

In some embodiments, the isolated antigens used for antibody isolation include a target epitope defined by atomic coordinates of those amino acids of the antigen that contact an antibody of interest that specifically binds the antigen. The gp120 and pg41 antigens have been modified to substitute the surface exposed amino acids located exterior to the target epitope of gp41 or gp120 to focus the antigenicity of the antigen to the target epitope. For example, the method can remove non-target epitopes that might interfere with specific binding of an antibody to the target epitope on gp120 or gp41. In some examples, the amino acid substitutions result in the antigen not being bound by antibodies in a polyclonal serum that specifically bind surface exposed amino acid residues of the wild-type antigen located exterior of the target epitope. In some embodiments, the amino acid substitutions alter antigenicity of the antigen in vivo as compared to the wild-type antigen (unsubstituted antigen) but do not introduce additional glycosylation sites as compared to the wild-type antigen. In some embodiments, that antigen is glycosylated. In some embodiments the cloaked antigen is modified to substitute one or more residues recognized by the antibody of interest to abolish antigen recognition. In some examples, a biotinylation peptide (for example SEQ ID NO: 26) can be fused to the cloaked antigen. Biotinylated cloaked antigen can then be used to stain and thus identify cells, such as PBMC, expressing an antibody of interest.

Additional recombinant human neutralizing antibodies that specifically bind the same epitope of gp120 bound by the antibodies disclosed herein that specifically bind gp120 (for example, the epitope of gp120 specifically bound by Vc2a11 (VRC01) and Vc2a34 (VRC02), or the specific epitope bound by VRC03, see the examples section below), or human neutralizing antibodies that specifically the same epitope of gp41 bound by antibodies that specifically bind gp41 (for example, the epitope bound by $L_{100A}W$, $F_{100B}W$, $V_{100D}W$, and $L_{100A}W$-$V_{100D}W$ variants of antibody 2F5, see the Examples section below), can be isolated by screening of a recombinant combinatorial antibody library, such as a Fab phage display library (see, for example, U.S. Patent Application Publication No. 2005/0123900). In some cases the phage display libraries are prepared using cDNAs of the variable regions of heavy and light chains prepared from mRNA derived from human lymphocytes. Methodologies for preparing and screening such libraries are known in the art. There are commercially available kits for generating phage display libraries (for example, the Pharmacia Recombinant Phage Antibody System, Catalog No. 27-9400-01; and the Stratagene SurfZAP™ phage display kit, catalog no. 240612). There are also other methods and reagents that can be used in generating and screening antibody display libraries (see, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; Fuchs et al., *Bio/Technology* 9:1370-1372, 1991; Hay et al., *Hum. Antibod. Hybridomas* 3:81-85, 1992; Huse et al., *Science* 246: 1275-1281, 1989; McCafferty et al., *Nature* 348:552-554, 1990; Griffiths et al., *EMBO J.* 12:725-734, 1993)

In one embodiment, to isolate additional human antibodies that specifically bind either gp120 or gp41, a neutralizing antibody that specifically binds gp120 or gp41, as described herein, is first used to select human heavy and light chain sequences having similar binding activity toward gp120 or gp41, such as using the epitope imprinting methods disclosed in PCT Publication No. WO 93/06213. The antibody libraries used in this method are scFv libraries prepared and screened, using methods such as those as described in PCT Publication No. WO 92/01047, McCafferty et al., *Nature* 348:552-554, 1990; and/or Griffiths et al., *EMBO J.* 12:725-734, 1993 using gp120.

Once initial human variable light chain ($V_L$) and variable heavy chain ($V_H$) segments are selected, "mix and match" experiments, in which different pairs of the initially selected $V_L$ and $V_H$ segments are screened for gp120 or gp41 binding, such as to the epitopes bound by VRC01, VRC02, and VRC03 (gp120) or to the epitope bound by the $L_{100A}W$, $F_{100B}W$, $V_{100D}W$, and $L_{100A}W$-$V_{100D}W$ variants of antibody 2F5 (in gp41) are performed to select $V_L/V_H$ pair combinations of interest. Additionally, to increase binding affinity of the antibody, the $V_L$ and $V_H$ segments can be randomly mutated, such as within H-CDR3 region or the L-CDR3 region, in a process analogous to the in vivo somatic mutation process responsible for affinity maturation of antibodies during a natural immune response. This in vitro affinity maturation can be accomplished by amplifying $V_H$ and $V_L$ regions using PCR primers complementary to the H-CDR3 or L-CDR3, respectively. In this process, the primers have been "spiked" with a random mixture of the four nucleotide bases at certain positions such that the resultant PCR products encode $V_H$ and $V_L$ segments into which random mutations have been introduced into the $V_H$ and/or $V_L$ CDR3 regions. These randomly mutated $V_H$ and $V_L$ segments can be tested to determine the binding affinity for gp120 or gp41. In particular examples, the $V_H$ amino acid sequence is SEQ ID NOs: 1, 3, 5, 6, 7, 8, 9, 27, or any one of 760-1459. In other examples, the $V_L$ amino acid sequence is SEQ ID NOs: 2, 4, 6 or 28.

Following screening and isolation of an antibody that binds gp120 or gp41 from a recombinant immunoglobulin display library, nucleic acid encoding the selected antibody can be recovered from the display package (for example, from the phage genome) and subcloned into other expression vectors by standard recombinant DNA techniques, as described herein. If desired, the nucleic acid can be further manipulated to create other antibody fragments, also as described herein. To express a recombinant antibody isolated by screening of a combinatorial library, the DNA encoding the antibody is cloned into a recombinant expression vector and introduced into a mammalian host cells, as described herein.

The antibodies or antibody fragments disclosed herein can be derivatized or linked to another molecule (such as another peptide or protein). In general, the antibody or portion thereof is derivatized such that the binding to gp120 or gp41 is not affected adversely by the derivatization or labeling. For example, the antibody can be functionally linked (by chemical coupling, genetic fusion, noncovalent association or otherwise) to one or more other molecular entities, such as another antibody (for example, a bispecific antibody or a diabody), a detection agent, a pharmaceutical agent, and/or a protein or peptide that can mediate associate of the antibody or antibody portion with another molecule (such as a streptavidin core region or a polyhistidine tag).

One type of derivatized antibody is produced by cross-linking two or more antibodies (of the same type or of different types, such as to create bispecific antibodies). Suitable crosslinkers include those that are heterobifunctional, having two distinctly reactive groups separated by an appropriate spacer (such as m-maleimidobenzoyl-N-hydroxysuccinimide ester) or homobifunctional (such as disuccinimidyl suberate). Such linkers are available from Pierce Chemical Company (Rockford, Ill.).

An antibody that specifically binds gp120 or gp41 can be labeled with a detectable moiety. Useful detection agents include fluorescent compounds, including fluorescein, fluorescein isothiocyanate, rhodamine, 5-dimethylamine-1-napthalenesulfonyl chloride, phycoerythrin, lanthanide phosphors and the like. Bioluminescent markers are also of use, such as luciferase, Green fluorescent protein, Yellow fluorescent protein. An antibody can also be labeled with enzymes that are useful for detection, such as horseradish peroxidase, β-galactosidase, luciferase, alkaline phosphatase, glucose oxidase and the like. When an antibody is labeled with a detectable enzyme, it can be detected by adding additional reagents that the enzyme uses to produce a reaction product that can be discerned. For example, when the agent horseradish peroxidase is present the addition of hydrogen peroxide and diaminobenzidine leads to a colored reaction product, which is visually detectable. An antibody may also be labeled with biotin, and detected through indirect measurement of avidin or streptavidin binding. It should be noted that the avidin itself can be labeled with an enzyme or a fluorescent label.

An antibody may be labeled with a magnetic agent, such as gadolinium. Antibodies can also be labeled with lanthanides (such as europium and dysprosium), and manganese. Paramagnetic particles such as superparamagnetic iron oxide are also of use as labels. An antibody may also be labeled with a predetermined polypeptide epitopes recognized by a secondary reporter (such as leucine zipper pair sequences, binding sites for secondary antibodies, metal binding domains, epitope tags). In some embodiments, labels are attached by spacer arms of various lengths to reduce potential steric hindrance.

An antibody can also be labeled with a radiolabeled amino acid. The radiolabel may be used for both diagnostic and therapeutic purposes. Examples of labels for polypeptides include, but are not limited to, the following radioisotopes or radionucleotides: $^{3}H$, $^{14}C$, $^{15}N$, $^{35}S$, $^{90}Y$, $^{99}Tc$, $^{111}In$, $^{125}I$, $^{131}I$.

An antibody can also be derivatized with a chemical group such as polyethylene glycol (PEG), a methyl or ethyl group, or a carbohydrate group. These groups may be useful to improve the biological characteristics of the antibody, such as to increase serum half-life or to increase tissue binding.

Means of detecting such labels are well known to those of skill in the art. Thus, for example, radiolabels may be detected using photographic film or scintillation counters, fluorescent markers may be detected using a photodetector to detect emitted illumination. Enzymatic labels are typically detected by providing the enzyme with a substrate and detecting the reaction product produced by the action of the enzyme on the substrate, and colorimetric labels are detected by simply visualizing the colored label.

B. Polynucleotides and Expression

Nucleic acid molecules (also referred to as polynucleotides) encoding the polypeptides provided herein (including, but not limited to antibodies) can readily be produced by one of skill in the art. For example, these nucleic acids can be produced using the amino acid sequences provided herein (such as the CDR sequences, heavy chain and light chain sequences), sequences available in the art (such as framework sequences), and the genetic code. The nucleic acids encoding the VRC01 heavy chain was deposited as ATCC Deposit Number PTA-10412; the nucleic acids encoding the VRC01 light chain was deposited as ATCC Deposit Number PTA-10411; the nucleic acids encoding the VRC02 heavy chain was deposited as ATCC Deposit Number PTA-10414; and the nucleic acids encoding the VRC02 light chain was deposited as ATCC Deposit Number PTA-10413. Nucleic acids encoding the VRC03 heavy chain and VRC03 light chain were deposited at the ATCC on Dec. 23, 2009 as ATCC Deposit Numbers PTA-10551 and PTA-10550, respectively. All deposits were made in accordance with the Budapest Treaty.

$V_H$ nucleic acid sequences are set forth as SEQ ID NOs: 29, 31, 33, and any one of 61-759 and include degenerate variants thereof. $V_L$ nucleic acid sequences are set forth as SEQ ID NOs: 30, 32 and 34, and include degenerate variants thereof. One of skill in the art can readily use the genetic code to construct a variety of functionally equivalent nucleic acids, such as nucleic acids which differ in sequence but which encode the same antibody sequence, or encode a conjugate or fusion protein including the $V_L$ and/or $V_H$ nucleic acid sequence.

Nucleic acid sequences encoding the antibodies that specifically bind gp120 or gp41 can be prepared by any suitable method including, for example, cloning of appropriate sequences or by direct chemical synthesis by methods such as the phosphotriester method of Narang et al., *Meth. Enzymol.* 68:90-99, 1979; the phosphodiester method of Brown et al., *Meth. Enzymol.* 68:109-151, 1979; the diethylphosphoramidite method of Beaucage et al., *Tetra. Lett.* 22:1859-1862, 1981; the solid phase phosphoramidite triester method described by Beaucage & Caruthers, *Tetra. Letts.* 22(20): 1859-1862, 1981, for example, using an automated synthesizer as described in, for example, Needham-VanDevanter et al., *Nucl. Acids Res.* 12:6159-6168, 1984; and, the solid support method of U.S. Pat. No. 4,458,066. Chemical synthesis produces a single stranded oligonucleotide. This can be converted into double stranded DNA by hybridization with a complementary sequence or by polymerization with a DNA polymerase using the single strand as a template. One of skill would recognize that while chemical synthesis of DNA is generally limited to sequences of about 100 bases, longer sequences may be obtained by the ligation of shorter sequences.

Exemplary nucleic acids can be prepared by cloning techniques. Examples of appropriate cloning and sequencing techniques, and instructions sufficient to direct persons of skill through many cloning exercises are found in Sambrook et al., supra, Berger and Kimmel (eds.), supra, and Ausubel, supra. Product information from manufacturers of biological reagents and experimental equipment also provide useful information. Such manufacturers include the SIGMA Chemical Company (Saint Louis, Mo.), R&D Systems (Minneapolis, Minn.), Pharmacia Amersham (Piscataway, N.J.), CLONTECH Laboratories, Inc. (Palo Alto, Calif.), Chem Genes Corp., Aldrich Chemical Company (Milwaukee, Wis.), Glen Research, Inc., GIBCO BRL Life Technologies, Inc. (Gaithersburg, Md.), Fluka Chemica-Biochemika Analytika (Fluka Chemie AG, Buchs, Switzerland), Invitrogen (Carlsbad, Calif.), and Applied Biosystems (Foster City, Calif.), as well as many other commercial sources known to one of skill.

Nucleic acids can also be prepared by amplification methods. Amplification methods include polymerase chain reaction (PCR), the ligase chain reaction (LCR), the transcription-based amplification system (TAS), the self-sustained sequence replication system (3SR). A wide variety of cloning methods, host cells, and in vitro amplification methodologies are well known to persons of skill.

Any of the nucleic acids encoding any of the antibodies, $V_H$ and/or $V_L$, disclosed herein (or fragment thereof) can be expressed in a recombinantly engineered cell such as bacteria, plant, yeast, insect and mammalian cells. These antibodies can be expressed as individual $V_H$ and/or $V_L$ chain, or can be expressed as as a fusion protein. An immunoadhesin can also be expressed. Thus, in some examples, nucleic acids encoding a $V_H$ and $V_L$, and immunoadhesin are provided. The nucleic acid sequences can optionally encode a leader sequence.

To create a single chain antibody, (scFv) the $V_H$- and $V_L$-encoding DNA fragments are operatively linked to another fragment encoding a flexible linker, e.g., encoding the amino acid sequence (Gly$_4$-Ser)$_3$, such that the $V_H$ and $V_L$ sequences can be expressed as a contiguous single-chain protein, with the $V_L$ and $V_H$ domains joined by the flexible linker (see, e.g., Bird et al., Science 242:423-426, 1988; Huston et al., Proc. Natl. Acad. Sci. USA 85:5879-5883, 1988; McCafferty et al., Nature 348:552-554, 1990). Optionally, a cleavage site can be included in a linker, such as a furin cleavage site.

The nucleic acid encoding the $V_H$ and/or the $V_L$ optionally can encode an Fc domain (immunoadhesin). The Fc domain can be an IgA, IgM or IgG Fc domain. The Fc domain can be an optimized Fc domain, as described in U.S. Published Patent Application No. 20100/093979, incorporated herein by reference. In one example, the immunoadhesin is an IgG1 Fc.

The single chain antibody may be monovalent, if only a single $V_H$ and $V_L$ are used, bivalent, if two $V_H$ and $V_L$ are used, or polyvalent, if more than two $V_H$ and $V_L$ are used. Bispecific or polyvalent antibodies may be generated that bind specifically to gp120 and to another molecule, such as gp41. The encoded $V_H$ and $V_L$ optionally can include a furin cleavage site between the $V_H$ and $V_L$ domains.

It is expected that those of skill in the art are knowledgeable in the numerous expression systems available for expression of proteins including *E. coli*, other bacterial hosts, yeast, and various higher eukaryotic cells such as the COS, CHO, HeLa and myeloma cell lines.

The host cell can be a gram positive bacteria including, but are not limited to, *Bacillus, Streptococcus, Streptomyces, Staphylococcus, Enterococcus, Lactobacillus, Lactococcus, Clostridium, Geobacillus*, and *Oceanobacillus*. Methods for expressing protein in gram positive bacteria, such as *Lactobaccillus* are well known in the art, see for example, U.S. Published Patent Application No. 20100/080774. Expression vectors for *lactobacillus* are described, for example in U.S. Pat. No. 6,100,388, and U.S. Pat. No. 5,728,571. Leader sequences can be included for expression in *Lactobacillus*. Gram negative bacteria include, but not limited to, *E. coli, Pseudomonas, Salmonella, Campylobacter, Helicobacter, Flavobacterium, Fusobacterium, Ilyobacter, Neisseria*, and *Ureaplasma*.

One or more DNA sequences encoding the antibody or fragment thereof can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art. Hybridomas expressing the antibodies of interest are also encompassed by this disclosure.

The expression of nucleic acids encoding the isolated proteins described herein can be achieved by operably linking the DNA or cDNA to a promoter (which is either constitutive or inducible), followed by incorporation into an expression cassette. The promoter can be any promoter of interest, including a cytomegalovirus promoter and a human T cell lymphotrophic virus promoter (HTLV)-1. Optionally, an enhancer, such as a cytomegalovirus enhancer, is included in the construct. The cassettes can be suitable for replication and integration in either prokaryotes or eukaryotes. Typical expression cassettes contain specific sequences useful for regulation of the expression of the DNA encoding the protein. For example, the expression cassettes can include appropriate promoters, enhancers, transcription and translation terminators, initiation sequences, a start codon (i.e., ATG) in front of a protein-encoding gene, splicing signal for introns, sequences for the maintenance of the correct reading frame of that gene to permit proper translation of mRNA, and stop codons. The vector can encode a selectable marker, such as a marker encoding drug resistance (for example, ampicillin or tetracycline resistance).

To obtain high level expression of a cloned gene, it is desirable to construct expression cassettes which contain, at the minimum, a strong promoter to direct transcription, a ribosome binding site for translational initiation (internal ribosmal binding sequences), and a transcription/translation terminator. For *E. coli*, this includes a promoter such as the T7, trp, lac, or lambda promoters, a ribosome binding site, and preferably a transcription termination signal. For eukaryotic cells, the control sequences can include a promoter and/or an enhancer derived from, for example, an immunoglobulin gene, HTLV, SV40 or cytomegalovirus, and a polyadenylation sequence, and can further include splice donor and/or acceptor sequences (for example, CMV and/or HTLV splice acceptor and donor sequences). The cassettes can be transferred into the chosen host cell by well-known methods such as transformation or electroporation for *E. coli* and calcium phosphate treatment, electroporation or lipofection for mammalian cells. Cells transformed by the cassettes can be selected by resistance to antibiotics conferred by genes contained in the cassettes, such as the amp, gpt, neo and hyg genes.

When the host is a eukaryote, such methods of transfection of DNA as calcium phosphate coprecipitates, conventional mechanical procedures such as microinjection, electroporation, insertion of a plasmid encased in liposomes, or virus vectors may be used. Eukaryotic cells can also be cotransformed with polynucleotide sequences encoding the antibody, labeled antibody, or functional fragment thereof, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, *Eukaryotic Viral Vectors*, Cold Spring Harbor Laboratory, Gluzman ed., 1982). One of skill in the art can readily use an expression systems such as plasmids and vectors of use in producing proteins in cells including higher eukaryotic cells such as the COS, CHO, HeLa and myeloma cell lines.

Modifications can be made to a nucleic acid encoding a polypeptide described herein without diminishing its biological activity. Some modifications can be made to facilitate the cloning, expression, or incorporation of the targeting molecule into a fusion protein. Such modifications are well known to those of skill in the art and include, for example, termination codons, a methionine added at the amino terminus to provide an initiation, site, additional amino acids placed on either terminus to create conveniently located restriction sites, or additional amino acids (such as poly His) to aid in purification steps. In addition to recombinant methods, the immunoconjugates, effector moieties, and antibodies of the present disclosure can also be constructed in whole or in part using standard peptide synthesis well known in the art.

Once expressed, the recombinant immunoconjugates, antibodies, and/or effector molecules can be purified according to standard procedures of the art, including ammonium sulfate precipitation, affinity columns, column chromatography, and the like (see, generally, R. Scopes, PROTEIN PURIFICATION, Springer-Verlag, N.Y., 1982). The antibodies, immunoconjugates and effector molecules need not be 100% pure. Once purified, partially or to homogeneity as desired, if to be used therapeutically, the polypeptides should be substantially free of endotoxin.

Methods for expression of antibodies and/or refolding to an appropriate active form, including single chain antibodies, from bacteria such as *E. coli* have been described and are well-known and are applicable to the antibodies disclosed herein. See, Buchner et al., *Anal. Biochem.* 205:263-270, 1992; Pluckthun, *Biotechnology* 9:545, 1991; Huse et al., *Science* 246:1275, 1989 and Ward et al., *Nature* 341:544, 1989.

Often, functional heterologous proteins from *E. coli* or other bacteria are isolated from inclusion bodies and require solubilization using strong denaturants, and subsequent refolding. During the solubilization step, as is well known in the art, a reducing agent must be present to separate disulfide bonds. An exemplary buffer with a reducing agent is: 0.1 M Tris pH 8, 6 M guanidine, 2 mM EDTA, 0.3 M DTE (dithioerythritol). Reoxidation of the disulfide bonds can occur in the presence of low molecular weight thiol reagents in reduced and oxidized form, as described in Saxena et al., *Biochemistry* 9: 5015-5021, 1970, and especially as described by Buchner et al., supra.

Renaturation is typically accomplished by dilution (for example, 100-fold) of the denatured and reduced protein into refolding buffer. An exemplary buffer is 0.1 M Tris, pH 8.0, 0.5 M L-arginine, 8 mM oxidized glutathione (GSSG), and 2 mM EDTA.

As a modification to the two chain antibody purification protocol, the heavy and light chain regions are separately solubilized and reduced and then combined in the refolding solution. An exemplary yield is obtained when these two proteins are mixed in a molar ratio such that a 5-fold molar excess of one protein over the other is not exceeded. Excess oxidized glutathione or other oxidizing low molecular weight compounds can be added to the refolding solution after the redox-shuffling is completed.

In addition to recombinant methods, the antibodies, labeled antibodies and functional fragments thereof that are disclosed herein can also be constructed in whole or in part using standard peptide synthesis. Solid phase synthesis of the polypeptides of less than about 50 amino acids in length can be accomplished by attaching the C-terminal amino acid of the sequence to an insoluble support followed by sequential addition of the remaining amino acids in the sequence. Techniques for solid phase synthesis are described by Barany & Merrifield, *The Peptides: Analysis, Synthesis, Biology. Vol. 2: Special Methods in Peptide Synthesis, Part A*. pp. 3-284; Merrifield et al., *J. Am. Chem. Soc.* 85:2149-2156, 1963, and Stewart et al., *Solid Phase Peptide Synthesis, 2nd ed.*, Pierce Chem. Co., Rockford, Ill., 1984. Proteins of greater length may be synthesized by condensation of the amino and carboxyl termini of shorter fragments. Methods of forming peptide bonds by activation of a carboxyl terminal end (such as by the use of the coupling reagent N,N'-dicylohexylcarbodimide) are well known in the art.

C. Isolation of Additional Antibodies with Enhanced Binding Properties

Epitope scaffolds have been used to isolate antibodies with particular binding specificity (See PCT Publication No. WO 2008/025015). Briefly, an epitope, such as an epitope of a pathogenic agent (for example, an epitope of an HIV-1 polypeptide) recognized by broadly neutralizing antibodies is placed into an appropriate peptide scaffold that preserves its structure and antigenicity. Such epitope scaffolds can then be used as an immunogen to elicit an epitope-specific antibody response in a subject. In another example, such scaffolds can be used to identify specific serum reactivities against the target epitope of the scaffold. This scaffolding technology is applicable not only to HIV-1, but to any pathogen for which a broadly neutralizing antibody and its respective epitope has been characterized at the atomic-level.

The design of epitope-protein scaffolds which elicit selected neutralizing antibodies is disclosed in PCT Publication No. WO 2008/025015, which is incorporated herein by reference. In general, the protocols utilize searchable databases containing the three dimensional structure of proteins, epitopes, and epitope-antibody complexes to identify proteins that are capable of structurally accommodating at least one selected epitope on their surface. Protein folding energetic predictions are further utilized to make energetic predictions. The predicted energies may be used to optimize the structure of the epitope-scaffold and filter results on the basis of energy criteria in order to reduce the number of candidate proteins and identify energetically stable epitope-scaffolds.

In one embodiment, a "superposition" epitope-scaffold can be designed and utilized. Superposition epitope-scaffolds are based upon scaffold proteins having an exposed segment on their surface with a similar conformation as a selected target epitope. The backbone atoms in this superposition region can be structurally superimposed onto the target epitope with less than a selected level of deviation from their native configuration. Candidate scaffolds are identified by computationally searching through a library of three-dimensional structures. The candidate scaffolds are further designed by putting epitope residues in the superposition region of the scaffold protein and making additional mutations on the surrounding surface of the scaffold to prevent undesirable interactions between the scaffold and the epitope or the scaffold and the antibody.

Superposition is advantageous in that it is a conservative technique. Epitope-scaffolds designed by superposition require only a limited number of mutations on the surface of known, stable proteins. Thus, the designs can be produced rapidly and a high fraction of the first round designs are likely to fold properly.

In another embodiment, "grafting" epitope scaffolds are utilized. Grafting epitope scaffolds utilize scaffold proteins that can accommodate replacement of an exposed segment with the crystallized conformation of the target epitope. For each suitable scaffold identified by computationally searching through a database of known three-dimensional structures, an exposed segment is replaced by the target epitope. The surrounding protein side chains are further mutated to accommodate and stabilize the inserted epitope. Mutations are further made on the surface of the scaffold to avoid undesirable interactions between the scaffold and epitope or scaffold and antibody. Grafting epitope-scaffolds should substantially mimic the epitope-antibody interaction, as the epitope is presented in substantially its native conformation. As such, grafting may be utilized to treat complex epitopes which are more difficult to incorporate using superposition techniques.

In certain embodiments, protein and design calculations are performed using the ROSETTA™ computer program to design the eptiope scaffolds. ROSETTA™ is a software application, developed at least in part at the University of Washington which provides protein structure predictions. ROSETTA™ utilizes physical models of the macromolecular interactions and algorithms for finding the lowest energy structure for an amino acid sequence in order to predict the structure of a protein. Furthermore ROSETTA™ may use these models and algorithms to find the lowest energy amino acid sequence for a protein or protein-protein complex for protein design. The ROSETTA™ energy function and several modules of the ROSETTA™ protein structure modeling and design platform are employed in the protein scaffold design discussed below.

Described herein are methods of increasing an antibody binding affinity and neutralizing capacity that utilize this epitope scaffolding technology. In the methods described herein, an original (parental) antibody that specifically binds a scaffolded epitope is identified and sequenced. The antibody binding determinants of antibody reactivity are then identified by mutagenesis (for example, amino acid substitutions) of the antibody sequences, wherein variant antibodies are produced. These amino acid substitutions can be made in one or more CDRs and/or in one or more framework regions of the original antibody. The amino acid substitutions can be a replacement of the amino acid in the original antibody for a tryptophan. In some embodiments, the antibodies include at most one, at most two, at most three or at most four amino acids substitutions, such as in the CDRs. These variant antibodies, such as the antibodies including one, two, three or four amino acids substitutions, are then evaluated for binding to the epitope scaffold. Antibodies are selected that have altered binding affinity for the epitope scaffold as compared to the original (parental) antibody.

In particular examples, selection of residues for mutagenesis is aided by structural modeling of the scaffold-antibody interaction. To produce an antibody with enhanced binding affinity, the amino acid(s) that have been identified as critical for antibody reactivity are then further substituted and the effects on antibody reactivity measured by further probing with the epitope scaffold.

Any method known to the art can be used to determine antibody-scaffold affinity. In some examples, the epitope scaffold probe is fused to a biotinylation peptide. In particular examples, the biotinylation peptide is SEQ ID NO: 26.

In some examples, the amino acid residues in the antibody that are responsible for specific binding to the epitope are indicated by a decrease in antibody affinity of the variant antibody as compared to the parental antibody. In some embodiments, antibodies are selected wherein binding is decreased by at least 20%, at least 30% at least 40% at least 50% at least 100% (2-fold), at least 200%, at least 300%, at least 400%, at least 500%, at least 600%, at least 700%, at least 800%, at least 900%, or at least 1,000% (10-fold) as compared to the original antibody. The decrease of affinity for the scaffold identifies the variant antibody as compared to the parental antibody to identify the one or more amino acids as critical for antigen binding. In one example, the complete loss of antibody binding affinity for the epitope scaffold identifies the one or more amino acid residues as critical for specific binding of antibody to the epitope.

In other embodiments, variant antibodies are selected wherein binding is increased by at least 20%, at least 30% at least 40% at least 50% at least 100% (2-fold), at least 200%, at least 300%, at least 400%, at least 500%, at least 600%, at least 700%, at least 800%, at least 900%, or at least 1,000% (10-fold) as compared to the parental antibody. An increase of the binding of the variant antibody as compared to the parental antibody identifies the one or more amino acid residues as critical for specific binding of the antibody to the epitope.

An exemplary method is disclosed herein (see the EXAMPLES section), wherein this technology is utilized for an antibody that specifically binds an antigenic glycoprotein of HIV. However, this method is broadly applicable to antibodies that specifically bind any antigen of interest. In some embodiments, the antibody specifically binds a pathogen of interest. Pathogens include viruses, fungi, bacteria, and protozoa. In other example the antibody specifically binds a tumor antigen of anteerest.

Figure 117:
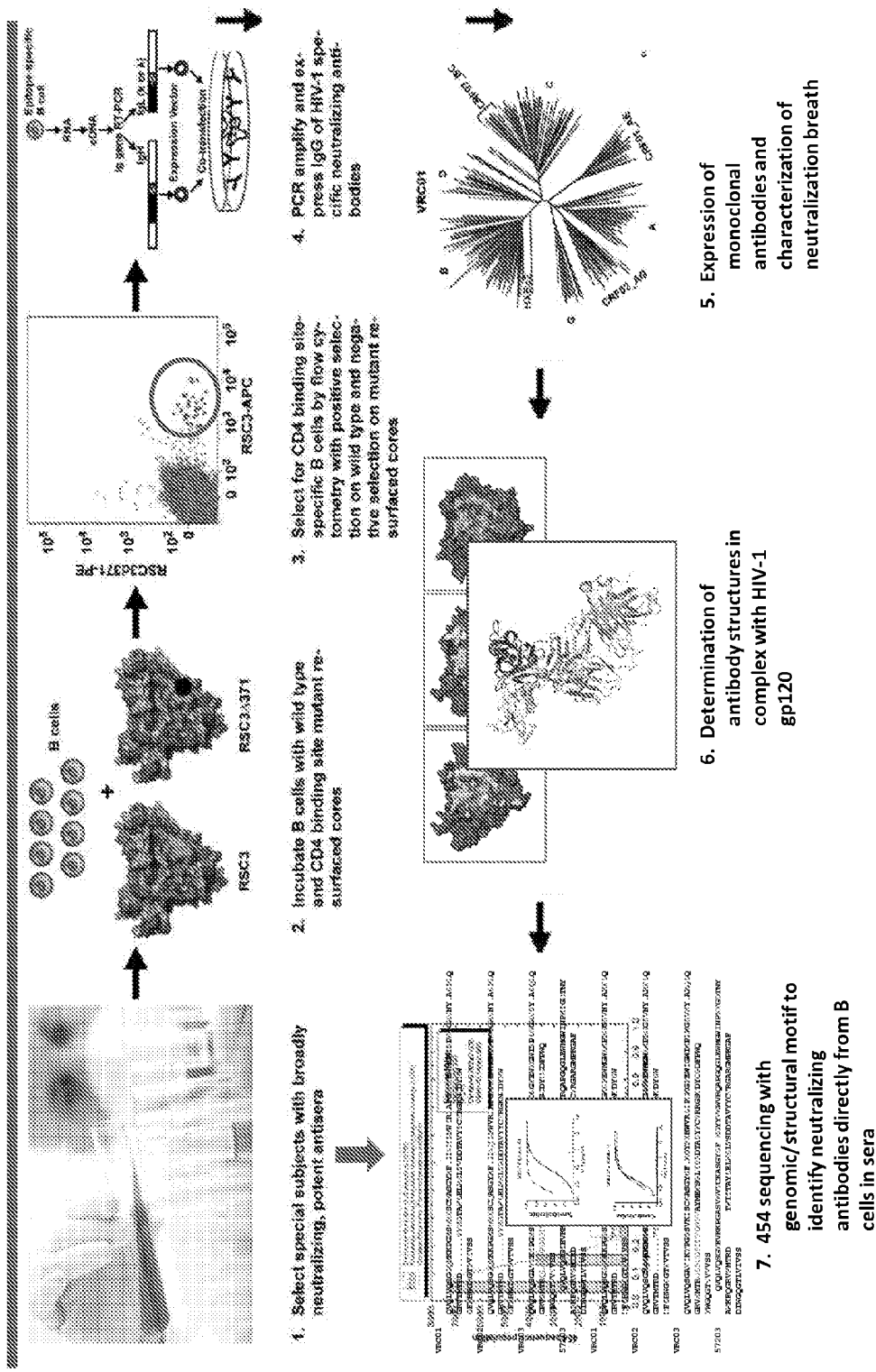

While this disclosure is written with specific reference to the identification of antibodies that are specific for HIV, such as antibodies specific for gp120 and gp140 from HIV, the methods disclosed herein, including those described in the EXAMPLES are equally applicable to the identification of other antigens, for example antigens from pathogenic sources as well as tumor antigens. In some examples, using the epitope scaffolds such as described in PCT Publication No. WO 2008/025015 can be used to identify epitope specific B-cells and isolate specific IgG clones that bind to a target epitope, such as the site of vulnerability ion the surface of gp120, as disclosed herein. With reference to FIG. 117, in some examples, a subject is selected that produces, or has broadly neutralizing sera, such that the B-cells isolated from that subject are believed express one or more broadly neutralizing antibodies to an antigen of interest, such as an antigen from a pathogenic organism or a tumor (see FIG. 117, 1). B-cells are isolated from the subject, for example using the procedures outlined in the EXAMPLES section, and the isolated B-cells are contacted with a target antigen of interest (see FIG. 117, 2), such as a resurfaced antigen, and the complex of the B-cells and the target antigen of interest is isolated (see FIG. 117, 3). Nucleic acids are obtained from the B-cells are analyzed and antibodies encoded by the Ig gene are synthesized (see FIG. 117, 4) and the antibodies are further characterized (see FIG. 117, 5). In some examples, the antibody antigen complexes are further characterized structurally, for example using X-ray diffraction methods (see FIG. 117, 6), which allows the important antibody/antigen contacts to be mapped. This information can be used to define classes of neutralizing antibodies specific for an antigen of interest, for example as is disclosed herein for the class of VRC01 and VRC03-like antibodies. The structural information about the antigen/antibody contacts and conformation can be analyzed in conjunction with sequencing data, such as 454 sequencing data, to identify additional antibodies that have the same or similar binding properties, in that they are highly specific for a specific neutralizing epitope on the surface of the antigen of interest. By combining sequence analysis, such as 454 sequencing with structural characterization of antibody/antigen interactions at the atomic level it is now possible to identify classes of neutralizing antibodies from a subject. As disclosed herein, this has now been demonstrated for HIV using designed gp120 antigens. In other words, the combination of sequencing, such as 454 sequencing with identified binding motifs in antibodies allows the identification of additional antibodies. Importantly, however, it allows for a short-cut (see e.g. steps 1-7 in FIG. 117) as these antibodies are directly identified from B-cells as these antibodies are directly identified from B-cells without the requirement for isolating antigen specific B cells. In doing so, it ties genomics technologies directly to sera characterization. This tie permits direct interrogation of the antibodyome, which is the family of antibodies specific for an antigen or even an organism or cancer, or interest. In some examples, the methods described herein can be used to examine a time course of antibody maturation from seroconversion to production of broadly neutralizing antibodies. In some embodiments, the methods described herein are used to monitor the development of antibodies in vaccines is a subject, for example to allow feedback at the antibody sequence level and subsequent redesign of the vaccines during vaccine development.

The methods disclosed herein have broad applications for of identifying specific antibodies, classes or species of antibodies with defined specificity, for example as exemplified by the identification of VRC01 and VRC03-like antibodies disclosed herein. This combination of structural and genomic analysis of Ig may provide a generic way of identifying specific antibodies, as well as classes or species of antibodies with defined specificities. Such antibodies, like VRC01 and related antibodies, can potentially be used for prevention strategies, such as microbicides or passive protection of HIV infection, vaccine design, diagnostics, and therapy of infected individuals.

Thus, viral antigenic epitopes can be used with the methods disclosed herein to identify classes of antibodies specific for the antigen of interest. Antigens of use in the methods disclosed herein include, but are not limited to, antigenic epitopes from dengue virus, human immunodeficiency virus, influenza virus, metapneumovirus, norovirus, papillomavirus, parvovirus, SARS virus, smallpox virus, picornaviruses, respiratory syncitial virus, parainfluenza virus, measles, hepatitis, measles, varicella zoster, rabies and West Nile virus, among many others. In some embodiments, the antigenic epitope is from a virus causes a respiratory disorder (for example, adeno, echo, rhino, coxsackie, influenza, parainfluenza, or respiratory syncytial virus), a digestive disorder (for example, rota, parvo, dane particle, or hepatitis A virus), an epidermal-epithelial disorder (for example, verruca, papilloma, molluscum, rubeola, rubella, small pox, cowpox), a herpes virus disease (for example, varicella-zoster, simplex I, or simplex II virus), an arbovirus disease (for example, dengue, yellow, or hemorrhagic fevers), a viral disease of the central nervous system (for example, polio or rabies), a viral heart disease, or acquired immune deficiency (AIDS). The antigenic epitope can also be from a bacteria. In some examples, bacteria antigenic epitope is a *Pyogenic cocci* antigen from an organism that causes, for example, staphylococcal, streptococcal, pneumococcal, meningococcal, and gonococcal infections; a gram-negative rod antigen from an organism that causes, for example, *E. coli, Klebsiella, enterobacter, pseudomonas*, or *legionella* infections; an antigenic epitope for an organism that causes, for example, *hemophilus influenza, bordetella pertussis*, or diphtheria infections. Also encompassed in this disclosure are bacterial antigens from enteropathic bacteria (for example, *S. typhi*), clostridia (for example, *C. tetani* or *C. botulinum*)), and mycobacteria (for example, *M. tuberculosis* or *M. leprae*). Exemplary antigens are the CFP10 polypeptide or a domain of other polypeptides of *Mycobacterium tuberculosis*, or of a domain of the pilus polypeptide of *Vibrio cholera*, the CjaA polypeptide of *Campylobacter coli*, the Sfb1 polypeptide of *Streptococcus pyogenes*, the UreB polypeptide *Helicobacter pylori*, or of other pathogenic organisms such as the circumsporozoite polypeptide of *Plasmodium falciparum*. Non-limiting examples of bacterial (including mycobacterial) epitopes can be found, for example, in Mei et al., *Mol. Microbiol.* 26:399-407, 1997; and U.S. Pat. Nos. 6,790,950 (gram negative bacteria); 6,790,448 (gram positive bacteria); 6,776,993 and 6,384,018 (*Mycobacterium tuberculosis*).

In additional examples, the antigenic epitope is from a *Chlamydia* that causes ornithosis (*C. psittaci*), chlamydial urethritis and cervicitis (*C. trachomatis*), inclusion conjunctivitis (*C. trachomatis*), trachoma (*C. trachomatis*), or lymphogranuloma venereum (*C. trachomatis*)). In additional examples, the antigen epitope is from *rickettsia* that causes typhus fever (*R. prowazekii*), Rocky Mountain spotted fever (*R. rickettsi*), scrub fever (*R. tsutsugamushi*), or Q fever (*Coxiella burnetii*).

In particular embodiments, the antigenic epitope is from a fungus, such as *Candidae* (for example, *C. albicans*) or *Aspergillis* (for example, *A. fumigatus*). In other embodiments, the protozoan antigen is from, for example, *Giardia Lamblia, Trichomoniasis, Pneumocystosis, Plasmodium, Leishmania*, or *Toxoplasma*. In further embodiments, the helminth antigen is from, for example, *Trichuris, Necator americanus* (hookworm disease), *Ancylostoma duodenale* (hookworm disease), *Trichinella spiralis*, or *S. mansoni*.

In additional embodiments, the method is applied to identify antibodies that bind antigenic epitopes of tumor antigens. Tumor antigens include, but are not limited to carcinoembryonic antigen ("CEA:" e.g., GENBANK® Accession No. AAA62835), ras proteins (see, e.g., Parada et al. *Nature* 297: 474-478, 1982), p53 protein (e.g., GENBANK® Accession No. P07193), prostate-specific antigen ("PSA:" e.g., GENBANK® Accession Nos. NP001639, NP665863), Muc1 (e.g., GENBANK® Accession No. P15941), tyrosinase (see, e.g., Kwon et al., *Proc Natl Acad Sci USA* 84:7473-7477, 1987, erratum *Proc Natl Acad Sci USA* 85:6352, 1988 Melanoma-associated antigen (MAGEs: for examples, see, U.S. Pat. Nos. 5,462,871; 5,554,724; 5,554,506; 5,541,104 and 5,558,995). The tumor antigen can be from a tumor of any organ or tissue, including but not limited to solid organ tumors. For example, the tumor can be melanoma, colon-, breast-, lung, cervical-, ovarian, endometrial, prostate-, skin-, brain-, liver-, kidney, thyroid, pancreatic, esophageal-, or gastric cancer, leukemias, lymphomas, multiple myeloma, myelodysplastic syndrome, premalignant human papiloma virus (HPV)-related lesions, intestinal polyps and other chronic states associated with increased tumor risk.

D. Compositions and Therapeutic Methods

Methods are disclosed herein for the prevention or treatment of an HIV infection, such as an HIV-1 infection. Preention can include inhibition of infection with HIV-1. The methods include contacting a cell with an effective amount of the human monoclonal antibodies disclosed herein that specifically binds gp120 or gp41, or a functional fragment thereof. The method can also include administering to a subject a therapeutically effective amount of the human monoclonal antibodies to a subject.

Methods to assay for neutralization activity include, but are not limited to, a single-cycle infection assay as described in Martin et al. (2003) *Nature Biotechnology* 21:71-76. In this assay, the level of viral activity is measured via a selectable marker whose activity is reflective of the amount of viable virus in the sample, and the IC50 is determined. In other assays, acute infection can be monitored in the PM1 cell line or in primary cells (normal PBMC). In this assay, the level of viral activity can be monitored by determining the p24 concentrations using ELISA. See, for example, Martin et al. (2003) *Nature Biotechnology* 21:71-76.

HIV infection does not need to be completely eliminated for the composition to be effective. For example, a composition can decrease HIV infection by a desired amount, for example by at least 10%, at least 20%, at least 50%, at least 60%, at least 70%, at least 80%, at least 90%, at least 95%, at least 98%, or even at least 100% (elimination of detectable HIV infected cells), as compared to HIV infection in the absence of the composition. In example, the cell is also contacted with an effective amount of an additional agent, such as anti-viral agent. The cell can be in vivo or in vitro. The methods can include administration of one on more additional agents known in the art. In additional examples, HIV replication can be reduced or inhibited by similar methods. HIV replication does not need to be completely eliminated for the composition to be effective. For example, a composition can decrease HIV replication by a desired amount, for example by at least 10%, at least 20%, at least 50%, at least 60%, at least 70%, at least 80%, at least 90%, at least 95%, at least 98%, or even at least 100% (elimination of detectable HIV), as compared to HIV replication in the absence of the composition. In one example, the cell is also contacted with an effective amount of an additional agent, such as anti-viral agent. The cell can be in vivo or in vitro.

Compositions are provided that include one or more of the antibodies that specifically bind gp120 or gp41, or functional fragments thereof, that are disclosed herein in a carrier. The compositions can be prepared in unit dosage forms for administration to a subject. The amount and timing of administration are at the discretion of the treating physician to achieve the desired purposes. The antibody can be formulated for systemic or local administration. In one example, the antibody that specifically binds gp120 or gp41 is formulated for parenteral administration, such as intravenous administration.

The compositions for administration can include a solution of the antibody that specifically binds gp120 or the antibody that specifically binds gp41 dissolved in a pharmaceutically acceptable carrier, such as an aqueous carrier. A variety of aqueous carriers can be used, for example, buffered saline and the like. These solutions are sterile and generally free of undesirable matter. These compositions may be sterilized by conventional, well known sterilization techniques. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like. The concentration of antibody in these formulations can vary widely, and will be selected primarily based on fluid volumes, viscosities, body weight and the like in accordance with the particular mode of administration selected and the subject's needs.

A typical pharmaceutical composition for intravenous administration includes about 0.1 to 10 mg of antibody per subject per day. Dosages from 0.1 up to about 100 mg per subject per day may be used, particularly if the agent is administered to a secluded site and not into the circulatory or lymph system, such as into a body cavity or into a lumen of an organ. Actual methods for preparing administrable compositions will be known or apparent to those skilled in the art and are described in more detail in such publications as *Remington's Pharmaceutical Science*, 19th ed., Mack Publishing Company, Easton, Pa. (1995).

Antibodies may be provided in lyophilized form and rehydrated with sterile water before administration, although they are also provided in sterile solutions of known concentration. The antibody solution is then added to an infusion bag containing 0.9% sodium chloride, USP, and typically administered at a dosage of from 0.5 to 15 mg/kg of body weight. Considerable experience is available in the art in the administration of antibody drugs, which have been marketed in the U.S. since the approval of RITUXAN® in 1997. Antibodies can be administered by slow infusion, rather than in an intravenous push or bolus. In one example, a higher loading dose is administered, with subsequent, maintenance doses being administered at a lower level. For example, an initial loading dose of 4 mg/kg may be infused over a period of some 90 minutes, followed by weekly maintenance doses for 4-8 weeks of 2 mg/kg infused over a 30 minute period if the previous dose was well tolerated.

A therapeutically effective amount of a human gp120-specific antibody or human gp41-specific antibody will depend upon the severity of the disease and/or infection and the general state of the patient's health. A therapeutically effective amount of the antibody is that which provides either subjective relief of a symptom(s) or an objectively identifiable improvement as noted by the clinician or other qualified observer. These compositions can be administered in conjunction with another therapeutic agent, either simultaneously or sequentially.

In one embodiment, administration of the antibody results in a reduction in the establishment of HIV infection and/or reducing subsequent HIV disease progression in a subject. A reduction in the establishment of HIV infection and/or a reduction in subsequent HIV disease progression encompass any statistically significant reduction in HIV activity. In some embodiments, methods are disclosed for treating a subject with an HIV-1 infection. These methods include administering to the subject a therapeutically effective amount of an antibody, or a nucleic acid encoding the antibody, thereby preventing or treating the HIV-1 infection.

Studies have shown that the rate of HIV transmission from mother to infant is reduced significantly when zidovudine is administered to HIV-infected women during pregnancy and delivery and to the offspring after birth (Connor et al., 1994 *Pediatr Infect Dis J* 14: 536-541). Several studies of motherto-infant transmission of HIV have demonstrated a correlation between the maternal virus load at delivery and risk of HIV transmission to the child. The present disclosure provides isolated human monoclonal antibodies that are of use in decreasing HIV-transmission from mother to infant. Thus, in some examples a therapeutically effective amount of a human gp120-specific antibody or human gp41-specific antibody is administered in order to prevent transmission of HIV, or decrease the risk of transmission of HIV, from a mother to an infant. In some examples, a therapeutically effective amount of the antibody is administered to mother and/or to the child at childbirth. In other examples, a therapeutically effective amount of the antibody is administered to the mother and/or infant prior to breast feeding in order to prevent viral transmission to the infant or decrease the risk of viral transmission to the infant. In some embodiments, both a therapeutically effective amount of the antibody and a therapeutically effective amount of another agent, such as zidovudine, is administered to the mother and/or infant.

For any application, the antibody can be combined with anti-retroviral therapy. Antiretroviral drugs are broadly classified by the phase of the retrovirus life-cycle that the drug inhibits. The disclosed antibodies can be administered in conjunction with Nucleoside and nucleotide reverse transcriptase inhibitors (nRTI), Non-nucleoside reverse transcriptase inhibitors (NNRTI), Protease inhibitors, Entry inhibitors (or fusion inhibitors), Maturation inhibitors, or a Broad spectrum inhibitors, such as natural antivirals. Exemplary agents include lopinavir, ritonavir, zidovudine, lamivudine, tenofovir, emtricitabine and efavirenz.

Single or multiple administrations of the compositions including the antibodies disclosed herein are administered depending on the dosage and frequency as required and tolerated by the patient. In any event, the composition should provide a sufficient quantity of at least one of the antibodies disclosed herein to effectively treat the patient. The dosage can be administered once but may be applied periodically until either a therapeutic result is achieved or until side effects warrant discontinuation of therapy. In one example, a dose of the antibody is infused for thirty minutes every other day. In this example, about one to about ten doses can be administered, such as three or six doses can be administered every other day. In a further example, a continuous infusion is administered for about five to about ten days. The subject can be treated at regular intervals, such as monthly, until a desired therapeutic result is achieved. Generally, the dose is sufficient to treat or ameliorate symptoms or signs of disease without producing unacceptable toxicity to the patient.

Controlled-release parenteral formulations can be made as implants, oily injections, or as particulate systems. For a broad overview of protein delivery systems see, Banga, A. J., *Therapeutic Peptides and Proteins: Formulation, Processing, and Delivery Systems*, Technomic Publishing Company, Inc., Lancaster, Pa., (1995). Particulate systems include microspheres, microparticles, microcapsules, nanocapsules, nanospheres, and nanoparticles. Microcapsules contain the therapeutic protein, such as a cytotoxin or a drug, as a central core. In microspheres the therapeutic is dispersed throughout the particle. Particles, microspheres, and microcapsules smaller than about 1 μm are generally referred to as nanoparticles, nanospheres, and nanocapsules, respectively. Capillaries have a diameter of approximately 5 μm so that only nanoparticles are administered intravenously. Microparticles are typically around 100 μm in diameter and are administered subcutaneously or intramuscularly. See, for example, Kreuter, J., *Colloidal Drug Delivery Systems*, J. Kreuter, ed., Marcel Dekker, Inc., New York, N.Y., pp. 219-342 (1994); and Tice & Tabibi, *Treatise on Controlled Drug Delivery*, A. Kydonieus, ed., Marcel Dekker, Inc. New York, N.Y., pp. 315-339, (1992).

Polymers can be used for ion-controlled release of the antibody compositions disclosed herein. Various degradable and nondegradable polymeric matrices for use in controlled drug delivery are known in the art (Langer, *Accounts Chem. Res.* 26:537-542, 1993). For example, the block copolymer, polaxamer 407, exists as a viscous yet mobile liquid at low temperatures but forms a semisolid gel at body temperature. It has been shown to be an effective vehicle for formulation and sustained delivery of recombinant interleukin-2 and urease (Johnston et al., *Pharm. Res.* 9:425-434, 1992; and Pec et al., *J. Parent. Sci. Tech.* 44(2):58-65, 1990). Alternatively, hydroxyapatite has been used as a microcarrier for controlled release of proteins (Ijntema et al., *Int. J. Pharm.* 112:215-224, 1994). In yet another aspect, liposomes are used for controlled release as well as drug targeting of the lipid-capsulated drug (Betageri et al., *Liposome Drug Delivery Systems*, Technomic Publishing Co., Inc., Lancaster, Pa. (1993)). Numerous additional systems for controlled delivery of therapeutic proteins are known (see U.S. Pat. No. 5,055,303; U.S. Pat. No. 5,188,837; U.S. Pat. No. 4,235,871; U.S. Pat. No. 4,501,728; U.S. Pat. No. 4,837,028; U.S. Pat. No. 4,957,735; U.S. Pat. No. 5,019,369; U.S. Pat. No. 5,055,303; U.S. Pat. No. 5,514,670; U.S. Pat. No. 5,413,797; U.S. Pat. No. 5,268,164; U.S. Pat. No. 5,004,697; U.S. Pat. No. 4,902,505; U.S. Pat. No. 5,506,206; U.S. Pat. No. 5,271,961; U.S. Pat. No. 5,254,342 and U.S. Pat. No. 5,534,496).

E. Diagnostic Methods and Kits

A method is provided herein for the detection of the expression of gp120 or gp41 in vitro or in vivo. In one example, expression of gp120 or gp41 is detected in a biological sample, and can be used to detect HIV-1 infection. The sample can be any sample, including, but not limited to, tissue from biopsies, autopsies and pathology specimens. Biological samples also include sections of tissues, for example, frozen sections taken for histological purposes. Biological samples further include body fluids, such as blood, serum, plasma, sputum, spinal fluid or urine.

In several embodiments, a method is provided for detecting AIDS and/or an HIV-1 infection in a subject. The disclosure provides a method for detecting HIV-1 in a biological sample, wherein the method includes contacting a biological sample with the antibody under conditions conducive to the formation of an immune complex, and detecting the immune complex, to detect the gp120 or gp41 in the biological sample. In one example, the detection of gp120 or gp41 in the sample indicates that the subject has an HIV infection. In another example, the detection of gp120 or gp41 in the sample indicates that the subject has AIDS. In another example, detection of gp120 or gp41 in the sample confirms a diagnosis of AIDS and/or an HIV-1 infection in a subject.

In some embodiments, the disclosed antibodies are used to test vaccines. For example to test if a vaccine composition assumes the same conformation as a gp120 or gp41 peptide. Thus provided herein is a method for detecting testing a vaccine, wherein the method includes contacting a sample containing the vaccine, such as a gp120 or gp41 immunogen, with the antibody under conditions conducive to the formation of an immune complex, and detecting the immune complex, to detect the vaccine g in the sample. In one example, the detection of the immune complex in the sample indicates that vaccine component, such as such as a gp120 or gp41 immunogen assumes a conformation capable of binding the antibody.

In one embodiment, the antibody is directly labeled with a detectable label. In another embodiment, the antibody that binds gp120 or gp41 (the first antibody) is unlabeled and a second antibody or other molecule that can bind the antibody that binds gp120 or gp41 is utilized. As is well known to one of skill in the art, a second antibody is chosen that is able to specifically bind the specific species and class of the first antibody. For example, if the first antibody is a human IgG, then the secondary antibody may be an anti-human-IgG. Other molecules that can bind to antibodies include, without limitation, Protein A and Protein G, both of which are available commercially.

Suitable labels for the antibody or secondary antibody are described above, and include various enzymes, prosthetic groups, fluorescent materials, luminescent materials, magnetic agents and radioactive materials. Non-limiting examples of suitable enzymes include horseradish peroxidase, alkaline phosphatase, beta-galactosidase, or acetylcholinesterase. Non-limiting examples of suitable prosthetic group complexes include streptavidin/biotin and avidin/biotin. Non-limiting examples of suitable fluorescent materials include umbelliferone, fluorescein, fluorescein isothiocyanate, rhodamine, dichlorotriazinylamine fluorescein, dansyl chloride or phycoerythrin. A non-limiting exemplary luminescent material is luminol; a non-limiting exemplary magnetic agent is gadolinium, and non-limiting exemplary radioactive labels include $^{125}$I, $^{131}$I, $^{35}$S or $^{3}$H.

The immunoassays and method disclosed herein can be used for a number of purposes. Kits for detecting a polypeptide will typically comprise an antibody that binds gp120 or gp41, such as any of the antibodies disclosed herein. In some embodiments, an antibody fragment, such as an Fv fragment or a Fab is included in the kit. In a further embodiment, the antibody is labeled (for example, with a fluorescent, radioactive, or an enzymatic label).

In one embodiment, a kit includes instructional materials disclosing means of use. The instructional materials may be written, in an electronic form (such as a computer diskette or compact disk) or may be visual (such as video files). The kits may also include additional components to facilitate the particular application for which the kit is designed. Thus, for example, the kit may additionally contain means of detecting a label (such as enzyme substrates for enzymatic labels, filter sets to detect fluorescent labels, appropriate secondary labels such as a secondary antibody, or the like). The kits may additionally include buffers and other reagents routinely used for the practice of a particular method. Such kits and appropriate contents are well known to those of skill in the art.

In one embodiment, the diagnostic kit comprises an immunoassay. Although the details of the immunoassays may vary with the particular format employed, the method of detecting gp120 or gp41 in a biological sample generally includes the steps of contacting the biological sample with an antibody which specifically reacts, under immunologically reactive conditions, to gp120 or gp41. The antibody is allowed to specifically bind under immunologically reactive conditions to form an immune complex, and the presence of the immune complex (bound antibody) is detected directly or indirectly.

F. Deposits

Plasmids including the nucleic acids encoding VRC01 heavy chain, VRC01 light chain, VRC02 heavy chain, VRC02 light chain were deposited in accordance with the Budapest Treaty at the American Type Culture Collection (ATCC) on Oct. 14, 2009. VRC01 heavy chain was deposited as ATCC Deposit Number PTA-10412, VRC01 light chain was deposited as ATCC Deposit Number PTA-10411, VRC02 heavy chain was deposited as ATCC Deposit Number PTA-10414, and VRC02 light chain was deposited as ATCC Deposit Number PTA-10413. Plasmids including nucleic acid sequences encoding the VRC03 heavy chain and VRC03 light chain were deposited in accordance with the Budapest Treaty at the ATCC on Dec. 23, 2009. VRC03 heavy chain was deposited as ATCC Deposit Number PTA-10551, VRC03 light chain was deposited as ATCC Deposit Number PTA-10550.

The following examples are provided to illustrate certain particular features and/or embodiments. These examples should not be construed to limit the disclosure to the particular features or embodiments described.

EXAMPLES

Example 1

Identification of Human Monoclonal HIV-1 gp120 Specific Neutralizing Antibodies

This example describes the isolation and characterization of the human monoclonal antibodies VRC01, VRC02, and VRC03.

Figure 1A:
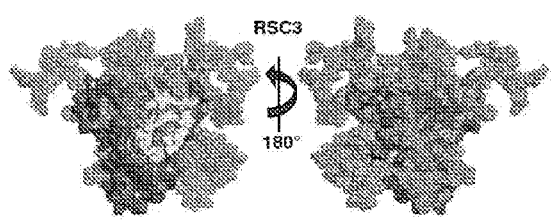
FIGS. 1A-1E are a set of surface representations and graphs showing the design and antigenic profile of RSC3 and analysis of epitope-specific neutralization.
Figure 1B:
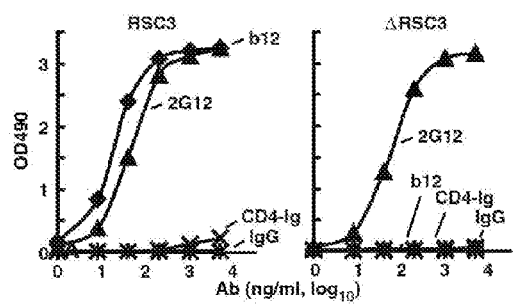
Figure 1C:
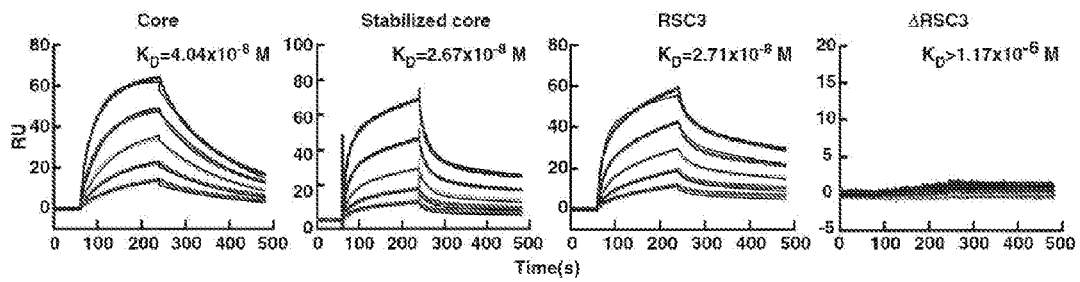

As disclosed herein, using knowledge of Env structure together with computer-assisted protein recombinant forms of HIV-1 Env were designed that specifically interact with neutralizing antibodies (Nabs) directed to the CD4 binding site (CD4bs) of the HIV gp120 glycoprotein. These Env probes were used to identify and sort individual B cells expressing CD4bs antibodies, enabling the selective isolation of CD4bs-directed monoclonal antibodies (mAbs) with extensive neutralization breadth. To generate a molecule that preserved the antigenic structure of the neutralizing surface of the CD4bs but eliminated other antigenic regions of HIV-1, proteins were designed whose exposed surface residues were substituted with simian immunodeficiency virus (SIV) homologs and other non-HIV-1 residues (FIG. 1A and FIG. 5). These changes were conferred on a core gp120 and a stabilized core gp120, both of which retained the major contact surface for CD4 located on its outer domain. The gp120 core lacked variable regions 1 to 3 and part of the amino and carboxy termini of the full gp120 molecule, and the stabilized core contained crosslinks between different subregions of the core protein. Eight resurfaced proteins were designed and expressed, together with CD4bs mutants that served as negative controls by eliminating binding to the neutralizing mAb b12. Three resurfaced core Envs retained strong reactivity with b12 and mAb 2G12 (FIG. 6), the latter of which recognizes a surface glycan epitope and served as a positive control for a conformationally intact protein. The resurfaced stabilized core 3 (RSC3) was chosen as the preferred candidate for further studies, because a greater percentage of its surface other than the outer domain CD4bs area was altered compared with the other variants (FIG. 6). The conformational integrity and specificity of the RSC3 protein was confirmed by using a panel of known mAbs (FIG. 14, Table S1). As expected, RSC3 displayed strong reactivity to mAb b12 and little or no reactivity to a CD4 fusion protein (FIGS. 1B and 1C). RSC3 also reacted with two weakly neutralizing CD4bs mAbs, b13 and m18, but it displayed no reactivity to four CD4bs mAbs that do not neutralize primary HIV-1 isolates, nor with mAbs directed to other regions of the HIV-1 Env, including the coreceptor-binding region of gp120 and the V3 and C5 regions of gp120 (FIG. 14, Table S1). DRSC3, which lacked a single amino acid at position 371 that eliminated b12 binding, served as a negative control. Together, these data confirmed the integrity of the antibody binding surface of this resurfaced protein, and it was used for analyses of sera and to identify B cells from an HIV-1-infected individual whose sera contained broadly reactive NAbs.

Figure 1D:
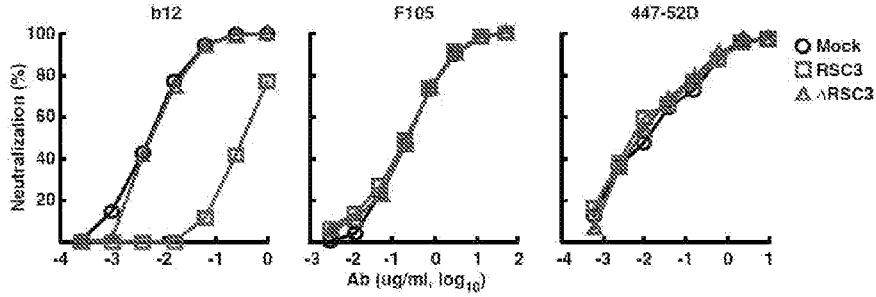
Figure 1E:
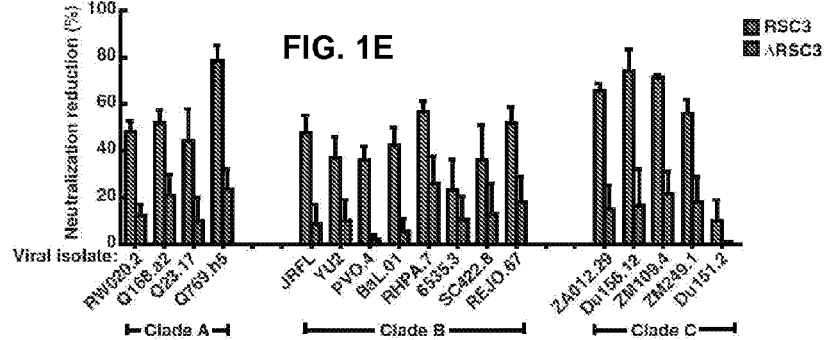

A panel of broadly neutralizing sera was screened for the presence of antibodies that could preferentially bind to RSC3 compared with DRSC3. CD4bs antibodies were detected in several sera, including serum from donor 45, which had been shown to contain NAbs directed to the CD4bs of gp120 (FIG. 7). To determine whether antibodies that bind to RSC3 were responsible for the broad neutralization mediated by serum 45, neutralization studies were performed by using RSC3 to compete cognate antibodies. The utility of this assay was confirmed with the CD4bs mAb b12 and with mAb F105, which binds differently to the CD4bs and does not bind RSC3 (FIG. 14, Table S1). mAb b12 neutralizes many primary HIV-1 strains, whereas F105 neutralizes mainly laboratory-adapted or other highly sensitive virus strains, such as the HXB2 strain. The addition of RSC3 but not DRSC3 inhibited b12-mediated neutralization of HXB2. RSC3 had no effect on F105 neutralization, and neither RSC3 nor DRSC3 affected neutralization by the anti-V3 mAb 447-52D (FIG. 1D). To interrogate serum 45 neutralization, RSC3 competition studies were performed with this serum against a panel of diverse HIV-1 strains (FIG. 1E). This analysis suggested that serum 45 neutralization was principally directed against the CD4bs on functional viral spikes and that the RSC3 faithfully mimicked this structure.

To isolate CD4bs-directed mAbs, a method of antigen-specific memory B cell sorting was used together with single cell polymerase chain reaction (PCR), to amplify immunoglobulin G (IgG) heavy- and light-chain genes from the cDNA of individual B cells. RSC3 and DRSC3 were expressed with a tagged amino acid sequence that allows biotin labeling. The two proteins could thus be distinguished by fluorescence-activated cell sorting (FACS) analysis after labeling with streptavidin (SA) conjugated to the fluorochromes allophycocyanin (SA-APC) or phycoerythrin (SA-PE), respectively. Peripheral blood mononuclear cells (PBMC) from donor 45 were incubated with RSC3 SA-APC and DRSC3 SA-PE, and single antigen-specific memory B cells were sorted into wells of a microtiter plate after selecting for memory B cells (CD19+, CD20+, and IgG+) that bound to the RSC3 but not the ΔRSC3 probe (FIG. 2A). Out of about 25 million PBMC, 29 single RSC3-specific memory B cells were sorted, and the matching heavy- and light-chain genes were successfully amplified from 12 cells. After cloning into IgG1 expression vectors that reconstituted the heavy and light-chain constant regions, the full IgG mAbs were expressed. Three antibodies (VRC01, VRC02, and VRC03) bound strongly to RSC3 and weakly or not at all to DRSC3 (FIG. 2B, left, FIG. 2C, and FIGS. 8 and 9). To confirm the specificity of these antibodies for the CD4bs, enzyme linked immunosorbent assay (ELISA) was used to test the binding of each mAb against a wild-type gp120 and the CD4bs-defective Asp368→Arg368 (D368R) mutant (FIG. 2B, right). VRC01 and VRC02 bound with ≥100-fold lower relative affinity to the heavy chain variable gene (VH) D368R mutant compared with wild-type gp120, and VRC03 showed no detectable binding to the CD4bs knockout mutant. The ELISA binding profile to an extended panel of mutant Env proteins further confirmed the CD4bs specificity of VRC01, VRC02, and VRC03 (FIG. 14, Table S1).

Analysis of the heavy- and light-chain nucleotide sequences using JoinSolver software (joinsolver.niaid.nih.gov) and the Immunogenetics Information System (IMGT) database (imgt.cines.fr) revealed that VRC01 and VRC02 were somatic variants of the same IgG1 clone. The heavy-chain CDR3 region of both mAbs was composed of the same 14 amino acids (FIG. 10), and both mAbs were highly somatically mutated, with 32% of the heavy chain variable gene (VH) and 17 to 19% of the kappa light chain variable gene (VK) nucleotides divergent from putative germline gene sequences. VRC03 was potentially derived from a different IgG1 clone, but its heavy chain was derived from the same IGHV1-02*02 and IGHJ1*01 alleles as VRC01 and VRC02. VRC03 was also highly somatically mutated, with an unusual seven-amino acid insertion in heavy-chain framework 3 and 30% of VH and 20% of VK nucleotides divergent from putative germline gene sequences. The heavy chain CDR3 of VRC03 contained 16 amino acids. All three mAbs share common sequence motifs in heavy-chain CDR1, CDR2, and CDR3.

The binding characteristics of the mAbs were further analyzed by surface plasmon resonance (SPR), competition ELISA, and isothermal titration calorimetry (ITC). SPR demonstrated that VRC01 (KD=3.88×10-9M) and VRC02 (KD=1.11×10-8 M) bound gp120 with high affinity whereas VRC03 reacted with about 10-fold lower affinity (KD=7.31× 10-8 M). To evaluate the epitope reactivity of these mAbs on gp120, competition ELISAs was performed with a panel of well-characterized mAbs. As expected, binding by all three VRC mAbs was competed by CD4bs mAbs b12 and F105 and by CD4-Ig (FIG. 3A left and FIG. 11A). Unexpectedly, the binding of mAb 17b to its site in the coreceptor binding region of gp120 was markedly enhanced by the addition of VRC01 or VRC02 (FIG. 3A right). This enhancing effect was similar, although not as profound, as the known effect of CD4-Ig. In contrast, mAb b12 inhibited mAb 17b binding (FIG. 3A right), as previously shown. A similar enhancing result was observed for VRC01 in an assay that measures gp120 binding to its CCR5 coreceptor (FIG. 11C). Thus, VRC01 and VRC02 act as partial CD4 agonists in their interaction with gp120, whereas VRC03 does not display this effect. Thermodynamic analysis by ITC provided data consistent with the ELISA results and demonstrated a change in enthalpy (−DH) associated with the VRC01-gp120 interaction that was similar to the interaction of CD4-Ig and gp120 (FIG. 3B), further demonstrating that VRC01 binding induced conformational changes in gp120. In contrast to the data for gp120 binding, VRC01 did not enhance viral neutralization by mAb 17b (FIG. 12). These data suggest that VRC01 and VRC02 partially mimic the interaction of CD4 with gp120. This may explain their broad reactivity, because essentially all HIV-1 isolates must engage CD4 for cell entry.

The potency and breadth of neutralization by VRC01, VRC02, and VRC03, compared with those by b12 and CD4-Ig, were assessed on a comprehensive panel of Env pseudoviruses (FIGS. 4 and 15-24, Table S2a-S2j). These 190 viral strains represented all major circulating HIV-1 genetic subtypes (clades) and included viruses derived from acute and chronic stages of HIV-1 infection. VRC01 neutralized 91% of these viruses with a geometric mean value of 0.33 mg/ml (FIGS. 4 and 15-24, Table S2a-S2j). The data for VRC02 were very similar (FIGS. 15-24, Table S2a-S2j). Of note, these mAbs were derived from an HIV-1 clade B-infected donor yet displayed neutralization activity against all genetic subtypes of HIV-1. VRC03 was less broad than VRC01 and VRC02, neutralizing 57% of the viruses (FIGS. 15-24, Table S2a-S2j). In contrast, b12, also derived from a clade B-infected donor, neutralized 41% of viruses tested. Because VRC01 was derived from a donor whose sera was also broadly neutralizing, the relationship between the neutralization breadth and potency of serum 45 IgG and mAb VRC01 was also assessed. Among 140 viruses tested, there was a significant association (P=0.005; Fisher's exact test) between the number of viruses neutralized by serum 45 IgG and the number neutralized by VRC01 (FIG. 13A). Among the 122 viruses neutralized by both serum IgG and VRC01, there was a strong association (P<0.0001; Deming linear regression) between the neutralization potency of the serum IgG and the potency of VRC01 (FIG. 13B). Therefore, although VRC01 did not account for all serum 45 IgG neutralization, the VRC01-like antibody specificity largely accounts for the extensive breadth and potency of serum 45. These findings demonstrate that a focused B cell response can target a highly conserved region of the HIV-1 Env in humans.

Other mAbs are able to neutralize HIV-1, but none has a profile of potency and breadth similar to VRC01 and VRC02. Antibody 4E10 requires relatively high concentrations to neutralize primary strains of HIV-1, and it neutralizes only 12% of Env-pseudoviruses at a concentration of less than 1 µg/ml. The well-characterized CD4bs mAb b12 and the more recently described HJ16 are informative with respect to antigen recognition, but each display restricted breadth (~40% of HIV-1 strains). Recently, two broadly neutralizing somatic variant mAbs, PG16 and PG9, were isolated by high-throughput neutralization screening of B cell supernatants. The PG16 and PG9 neutralized 73% and 79%, respectively, of viruses tested and recognized a glycosylated region of HIV-1 Env that is present on the native viral trimer, but this epitope is not well presented on gp120 or gp140. VRC01 and VRC02 access the CD4bs region of gp120 in a manner that partially mimics the interaction of CD4 with gp120. This observation may explain their impressive breadth of reactivity. The isolation of these mAbs from an HIV-1-infected donor and the demonstration that they neutralize the vast majority of HIV-1 strains by targeting the functionally conserved receptor binding region of Env provides proof of concept that such antibodies can be elicited in humans. The discovery of these mAbs provides new insights into how the human immune system is able to effectively target a vulnerable site on the viral Env.

Materials and Methods

Human Specimens.

The sera and peripheral blood mononuclear cells (PBMC) described in this Example were from HIV-1 infected individuals enrolled in investigational review board approved clinical protocols at the National Institute of Allergy and Infectious Diseases. Donor 45, from whom mAbs VRC01, VRC02 and VRC03 were isolated, has been HIV-1 infected with a clade B virus for more than 15 years. He is a slow progressor with CD4 T-cell counts over 500 cells/µl, plasma HIV-1 RNA values less than 15,000 copies/ml. He has not initiated antiretroviral treatment.

Computational Design of the Antigenically Resurfaced Core (RC) and Resurfaced Stabilized Core (RSC) Proteins.

The atomic level structures of HIV-1 gp120 in complex with CD4 (Protein Data Bank (PDB) ID: 2NXY), b12 (PDB ID: 2NY7), and F105 (PDB ID: 3HI1) defined the CD4-binding footprint, and neutralizing (b12) as well as non-neutralizing (F105) antibody epitopes on gp120. These structures were used to guide the computational design of new gp120 proteins that maintain the b12 neutralizing epitope but modify the antigenic surface outside the b12 epitope. Modifications outside the b12 epitope included, but were not limited to, mutations to eliminate CD4 and F105 binding and trimming the V1/V2 to eliminate co-receptor epitopes. Designs of most of the resurfaced proteins were based on the wild-type HXB2 core in PDB ID: 2NXY to optimize expression and folding. However, since the stabilized core version of gp120 HXB2 Ds12F123 eliminates binding to most non-neutralizing antibodies and keeps b12 binding intact, some designs (including RSC3) were based on the stabilized core version of gp120 HXB2 Ds12F123.

The general algorithm of the resurfacing design is illustrated in FIG. 5A. First, candidate resurfacing positions on gp120 were identified as surface exposed positions that do not contact the antibody (b12) and are not within or near an N-glycosylation site. Next, the set of amino acids allowed at each resurfacing position was assigned semi-automatically, employing a combination of different types of information (evolutionary information, structural and 2 solubility considerations, and similarity/differences with wild-type or pre-existing designs). Finally, ROSETTADESIGN™ was used to select low energy sequences. Different final designs were generated largely by devising different sets of allowed amino acids at each design position, but also by modifying the design positions themselves. The genes of the resurfaced proteins were synthesized for cloning, and the RC and RSC proteins were expressed and characterized for antigenic properties. What follows are details on the process and the individual designs.

Identification of Resurfacing Positions.

CD4- and b12-contacting residues as well as the surface accessibility of each residue on gp120 were determined based on the gp120-CD4 and gp120-b12 structures (PDB ID 2NXY and 2NY7). Surface exposed residues were defined using the program NACCESS (bioinf.manchester.ac.uk/naccess) as residues with >40% side-chain surface area exposed, relative to the same side-chain in an isolated tripeptide. Antibody contact residues were defined as any gp120 residue with at least one heavy atom within 8.0 angstroms of a heavy atom on the antibody. Residues near N-glycosylation sites were defined as any residue with at least one side-chain heavy atom within 6.0 angstroms of any heavy atom on either the Nacetyl-glucosamine (NAG) group or the asparagine of a N-glycosylation site (NXS/T, where X is any residues except proline). Initially, 49 candidate positions were identified on b12-bound gp120 (PDB ID: 2NY7), but the above criteria were relaxed in some cases to allow additional design positions, and in other cases design positions were restricted to generate pairs of molecules with resurfacing mutations at complementary sets of positions.

Semi-Automatic Assignment of Amino Acid Libraries.

Different strategies were used to assign libraries of allowed amino acids at each resurfacing position, in order to obtain different final sequences from ROSETTADESIGN™. For the design of RSC2, amino acids from a multiple sequence alignment of HIV-1 HXB2 with SIV (hiv.1an1.gov) were allowed (evolutionary information), but most hydrophobic residues were disallowed unless packed on the surface of a beta sheet, and all polar and the native HIV-1 residues were allowed (structural and solubility considerations). RC1 was derived from RSC2 by threading the final RSC2 sequence onto the CD4-bound structure (2NXY) and reverting mutations that would destabilize the CD4-bound conformation. The design of RSC3 was carried out following experimental feedback that RSC2 successfully maintained nM b12 affinity. For RSC3, most mutations from RSC2 were enforced, a wider range of amino acids were allowed at some positions that had not been mutated in RSC2, and additional resurfacing positions were selected based on both exposure and distance from mutations in RSC2. The goal was to ensure that as many potential antibody footprints of area ~20 Å2 outside the b12-binding site as possible contained at least one mutation. The criteria for resurfacing positions were relaxed for RSC3— eight of the new positions were near a NAG, and six were slightly less than 40% exposed. Finally, the native amino acid was not allowed at the new RSC3 design positions, guaranteeing increased resurfacing surface coverage. Resurfacing positions and allowed amino acids for RC4-8 were designed to increase the resurfaced area and antigenic diversity of RC1, following experimental feedback that RC1 maintained high b12 affinity. RC8 was generated using an expanded set of design positions and nearly only polars were allowed at all design positions. RC7 was generated using the same design positions as RC8, but the amino acids chosen for RC8 were disallowed at most design positions, and native amino acids were disfavored directly by assigning them a small energetic penalty. RC4 and RC5 utilized different resurfacing positions compared to RC1, RC7, and RC8 wherever possible, were restricted to polar mutations, and RC5 was designed to be antigenically different than RC4 by disallowing amino acids chosen for RC4. RC6 used the same design positions as RC1, but expanded beyond those positions, and disallowed the amino acids used in RC1.

ROSETTADESIGN™ parameters. In all cases non-exposed amino acids were held fixed at the native rotamer. In most cases surface exposed amino acids that were kept as native were also held fixed at the native rotamer. For design of RSC3, amino acids designed into the parent RSC2 were allowed to repack during design of RSC3. The lowest energy design for a particular combination of resurfacing positions and allowed amino acids was selected for experimental testing.

RSC2 and RSC3 Sequences.

The final RSC2 and RSC3 designs contained 34 and 61 mutations relative to the stabilized core (HXB2 Ds12F123) in PDB ID: 2NY7, respectively (not including the V1/V2 trim discussed below). The stabilized core has a total of 330 amino acids, so the resurfacing mutations in RSC2 and RSC3 amounted to modifications of 10% and 18% of the protein, respectively. For RSC3, 82% (50/61) of the mutations were contained in the SIV multiple sequence alignment and 18% (11/61) were not, illustrating that structural and solubility considerations contributed to the design. Only 11 (18%) of the final RSC3 mutations were 4 contained within the sequence of SIVmac32H, illustrating the importance of using a multiple sequence alignment rather than a single sequence. Mutations for all the resurfaced proteins are highlighted in the sequence alignment in FIG. 5B.

Eliminating CD4 and F105 Binding.

RSC2 and RSC3 were designed on the stabilized core that already eliminates F105 binding. To eliminate CD4 binding, the resurfacing described above was expected to suffice due to mutations of two CD4 contact residues in the β20/21 (mutations were N425G and W427V) and due to the favored b12-bound conformation of the β20/21 over the bridging sheet conformation necessary for CD4 binding (by mutations in β20/21 and in α1 which is linked to (32021 by a disulfide in RSC3). To eliminate F105-binding for RC1 and RC4-8 mutations at key F105 contact locations were added to the resurfacing design. To eliminate CD4 binding for RC1 and RC4-8, the β20/21 was truncated to GG between I423 and Y435.

V1/V2 Stem Trimming.

The V1/V2 was trimmed differently in different constructs, attempting to find minimal truncation while maintaining high protein expression. RSC2 utilized the same V1N2 trim as the stabilized core in the b12-crystal structure (PDB ID: 2NY7), but RSC3 had a more aggressively truncated V1/V2 (see alignment in FIG. 5B). RC1 and RC4-8 used a V1/V2 trim sequence of VKLTPLAGATSVITQA (SEQ ID NO. 1466) between C119 and C205.

Protein Expression and Purification.

Genes for HXB2 core, the stabilized core (HXB2 Ds12F123) and the designed RC and RSCs were each synthesized with a C-terminal His tag by GeneArt (Regensburg, Germany), and cloned into a mammalian CMV/R expression vector. Proteins were produced by transient transfection using 293fectin (Invitrogen, Carlsbad, Calif.) in 293F cells, a human embryonic kidney cell line (Invitrogen) maintained in serum-free free-style medium (Invitrogen). Culture supernatants were harvested 4-5 days after transfection, filtered through a 0.45 μm filter, and concentrated with buffer-exchange into 500 mM NaCl, 50 mM Tris (pH 8.0). Proteins were first purified by Co-NTA (cobalt-nitrilotriacetic acid) chromatography method using a HiTrap IMAC HP column (GE Healthcare, Piscataway, N.J.). The peak fractions were collected, and further purified by gel-filtration using a HiLoad 16/60 Superdex 200 pg column (GE Healthcare). The fractions containing monomers of each protein were combined, concentrated and flash frozen at −80° C. To generate the surface plasmon resonance (SPR) data 5 shown in FIG. 2C and FIGS. 8 and 9, both RSC3 and the stabilized core (Ds12F123) were further purified using b12 affinity column. Monomeric gp120s were expressed by transient transfection of 293F cells.

Surface Plasmon Resonance (SPR).

The binding kinetics of gp120 variants with different ligands were assessed by SPR analysis on Biacore 3000 or Biacore T-100 (GE Healthcare). HIV6 1 gp120-reactive ligands (CD4-Ig and specific mAbs) were either immobilized directly onto a CM5 sensor chip with standard amine coupling or captured with a mouse anti-human IgG Fc antibody supplied in the "human antibody capture kit" (GE Healthcare) to a surface density about 300 response units (RU). Variant gp120s at 5-200 nM were first passed over the modified sensor chips at 30 μl/min for 3-4 minutes, followed by a 5 minutes dissociation phase to identify rough binding affinities. Then a 2-fold increasing series of gp120 concentrations were passed over the chip, with the concentration of the series adjusted so that at least three runs resulted in maximum 10-150 RU.

Accompanying each gp120 series, blank reference using buffer to mock gp120 was included. The buffer in all studies was 10 mM HEPES, pH 7.4, 150 mM NaCl, 3 mM EDTA, and 0.01% surfactant P-20. Sensorgrams were corrected with blank reference and fit globally with Biacore Evaluation software using a 1:1 Langmuir model of binding. Although CD4-Ig and other ligands might formally be analyzed with a two-state binding model, such treatment should not affect the primary on-rates nor overall KDs reported here.

ELISA Analyses.

Each antigen in PBS (pH 7.4) at 2 μg/ml was used to coat plates overnight at 4° C. Coated plates were blocked with B3T buffer (150 mM NaCl, 50 mM Tris-HCl, 1 mM EDTA, 3.3% fetal bovine serum, 2% bovine albumin, 0.07% Tween 20) for 1 hour at 37° C., followed by incubation with sera or antibody serially diluted in B3T buffer for 1 hour at 37° C. Horseradish peroxidase (HRP)-conjugated goat anti-human IgG Fc antibody (Jackson ImmunoResearch Laboratories Inc., West Grove, Pa.) at 1:10,000 was added for 1 hour at 37° C. All volumes were 100 μl/well except that 200 μl/well was used for blocking. Plates were washed between each step with 0.1% Tween 20 in PBS. Plates were developed using either 3,3',5,5'-tetramethylbenzidine (TMB) (Kirkegaard & Perry Laboratories) and read at 450 nm, or ophenylenediamine dihydrochloride (Sigma) and read at 490 nm. For competitive ELISA analyses, plates were coated with 1 μg/ml of a sheep anti-gp120 C5 antibody, D7324 (Cliniqa Corp., Fallbrook, Calif.) or 10 μg/ml of *Galanthus nivalis* lectin (Sigma) to capture 2 μg/ml of purified YU2 gp120 or RSC3 respectively.

After blocking, serial dilutions of the competitor antibodies or CD4-Ig were added to the captured gp120 or RSC3 in 50 µl of B3T buffer, followed by adding 50 µl of biotin-labeled antibody at fixed concentrations: 100 ng/ml for VRC01 and VRC02 for both proteins, 4 µg/ml for VRC03 for YU2 gp120 or 100 ng/ml for RSC3, and 20 ng/ml for 17b for YU2 gp120. The plates were incubated at 37° C. for 1 hour, followed by incubation with 250 7 ng/ml of streptavidin-HRP (Sigma) at ambient temperature for 30 minutes, and developed with TMB as described.

Isothermal Titration calorimetry (ITC).

Isothermal titration calorimetry (ITC) was carried out using ITC200 microcalorimeter system from MicroCal, Inc. All proteins were thoroughly dialyzed against PBS before use. The dialysis buffer was filtered through a 0.2 µm membrane and used to dilute the protein samples. The concentration of gp120 in the sample cell was approximately 5 µM and that of CD4-Ig or mAbs in the syringe was approximately 25 µM. The molar concentrations of the proteins were calculated using the following molar extinction coefficients: gp120, 1.52; CD4-Ig, 1.2; b12, 1.46; VRC01, 1.53; VRC03, 1.57. Gp120 in the sample cell were titrated to saturation by the stepwise addition of 2 µl of ligand from the syringe at 120-sec intervals at 37° C. The heat evolved upon each injection was obtained from the integral of the calorimetric signal. The values for enthalpy ($\Delta H$) and entropy ($\Delta S$) were obtained by fitting the data to a nonlinear least-squares analysis with Origin software.

Viral Entry, Neutralization and Protein Competition Assays.

Neutralization was measured using single round infection by HIV-1 Env-pseudoviruses and TZM-b1 target cells. Neutralization curves were fit by nonlinear regression using a 5-parameter hill slope equation. The 50% and 80% inhibitory concentrations (IC50 and IC80) were reported as the antibody concentrations required to inhibit infection by 50% and 80% respectively. Competition of serum or mAb neutralization was assessed by adding a fixed concentration (25 µg/ml) of the RSC3 or $\Delta$RSC3 glycoprotein to serial dilutions of antibody for 15 min prior to the addition of virus. The resulting IC50 values were compared to the control with mock protein added. The neutralization blocking effect of the proteins was calculated as the percent reduction in the IC50 value of the antibody in the presence of protein compared to PBS. Synergistic or additive neutralization was assessed by mixing a fixed concentration (10 µg/ml) of the test antibody with serial dilutions of sCD4, CD4-Ig or VRC01 for 15 min prior to the addition of virus. The baseline of viral entry at each concentration of sCD4, CD4-Ig or VRC01 was used to calculate the adjusted percent neutralization. Neutralization was also assessed 8 using Env-pseudoviruses generated by 293T transfection using the pNL4-3 $\Delta$Env HIV-1 backbone containing a luciferase reporter gene to infect activated PBMC. Neutralizations using uncloned PBMC-derived HIV-1 primary isolates were performed by single-round infection of either TZM-b1 cells using luciferase as readout, or activated PBMC using flow cytometry staining for HIV-1 p24 antigen. CD4-facilitated virus entry was performed in the CCR5+/CD4− cell line Cf2Th/syn CCR5 with Env-pseudoviruses containing the luciferase pNL4-3 $\Delta$Env HIV-1 backbone. A mixture of 40 µl of viral stock and 10 µl of serial dilutions of sCD4, CD4-Ig or VRC01 was incubated at 37° C. for 30 min before adding 1×104 Cf2Th/syn CCR5 cells. Virus entry was measured 2 days later by luciferase activity in cell lysates.

Construction of the HIV-1 Envelope Sequence Dendrogram.

HIV-1 gp160 protein sequences (excluding the signal peptide) of HXB2 and the 190 isolates used in the neutralization assays were aligned using MUSCLE, for multiple sequence comparison by log-expectation. The protein distance matrix was calculated by "protdist" and the dendrogram was constructed using the neighbor joining method by "Neighbor". All analysis and the programs used were performed at the NIAID Biocluster (niaid-biocluster.niaid.nih.gov). The tree was displayed with Dendroscope.

Isolation of Antigen-Specific Memory B Cells by Fluorescence Activated Cell Sorting (FACS).

The plasmid constructs for RSC3 and $\Delta$RSC3 were modified by the addition of the sequence encoding the Avi-tag signal for biotinylation (LNDIFEAQKIEWHE, SEQ ID NO: 26) at the 3' end of the gene, and the modified genes were subcloned into the CMV/R expression vector. After expression and purification, the proteins were biotinylated at 40 µM utilizing biotin ligase Bir A (Avidity, Denver, Colo.) at 30° C. for 30 min, followed by removal of excess free biotin and buffer exchange with PBS (pH 7.4) using a 30-kDa Centricon plus filter (Millipore). Biotinylation of the RSC proteins was confirmed by ELISA. To conjugate proteins with the streptavidin-fluorochrome reagents, in a stepwise process, ⅕ of the molar equivalent of the streptavidin-fluorochrome reagent was added to the biotinylated RSC3 or $\Delta$RSC3 at 20-min intervals until the molar ratio of streptavidin-fluorochrome reagent:biotinylated protein reached 1:1. The incubation was carried out at 4° C. with gentle rocking. Streptavidin-allophycocyanin (SA-APC) (Invitrogen) was 9 mixed with biotinylated RSC3 and streptavidin-phycoerythrin (SA-PE) (Sigma) was mixed with biotinylated $\Delta$RSC3. Thus, each protein carried a different fluorochrome: RSC3-SA-APC and $\Delta$RSC3-SA-PE.

Antigen specific B cells were identified with a panel of ligands including fluorescently labeled antibodies for CD3, CD8, CD19, CD20, CD27, CD14, IgG and IgM. PBMC were stained with an antibody cocktail consisting of anti-CD3-APC-Cy7 (BD Pharmingen), CD8-Qdot705 (VRC), CD19-Qdot585 (VRC), CD20-Pacific Blue (VRC), CD27-APC-AlexaFluor700 (Beckman Coulter), CD14-Qdot800 (VRC), IgG-FITC (BD Pharmingen), and IgM-PE-Cy5 (BD Pharmingen). In addition, aqua blue (Invitrogen) was used to exclude dead cells. A total of 25 million cryopreserved PBMC were thawed and resuspended in 10 ml RPMI 1640 medium (Invitrogen) with 10% fetal bovine serum pre-warmed to 37° C. and treated with 20 µg/ml DNase I (New England Biolabs, Ipswich, Mass.), followed by centrifugation at 860×G for 5 min. Medium was removed and the cells were resuspended in 10 ml chilled PBS followed by centrifugation at 860×G for 5 min. The cell pellet was resuspended in 50 µl of chilled PBS with the aqua blue dye and stained at 4° C. in dark for 20 min. The antibody cocktail and the RSC3 and $\Delta$RSC3 multimers, in a total volume of 50 µl, was added to the cells and incubated at 4° C. in dark for 1 hour. The cells were washed with 10 ml cold PBS, resuspended in 2 ml cold PBS and passed through a 70-µm cell mesh (BD Biosciences). The stained PBMC were analyzed and sorted using a modified 3-laser FACSAria cell sorter using the FACSDiva software (BD Biosciences). Fluorescence compensation was performed using anti-mouse Ig Kappa compensation beads (BD Biosciences) stained with each antibody in a separate tube. For the CD3-APC-Cy7 antibody, anti-mouse IgH&L COMPtrol beads (Spherotech, Lake Forrest, Ill.) were used and the aqua blue fluorescence was compensated using pre-labeled amine-beads. Single cells with the phenotype of CD3-, CD8-, aqua blue-, CD14-, CD19+, CD20+, IgG+, IgM-, RSC3+ and ΔRSC3- were defined as CD4bs directed antigen specific B cells, and single cells were sorted into 96-well PCR plates containing 20 µl of lysis buffer per well. The lysis buffer contained 0.5 µl of RNase Out (Invitrogen), 5 µl of 5× first strand buffer (Invitrogen), 1.25 µl of 0.1M DTT (Invitrogen) and 0.0625 µl of Igepal (Sigma). The PCR plates with sorted cells were quickly frozen on dry-ice and stored at -80° C. The total content of the patient PBMC sample 10 passing through the sorter was saved in FCS files for further analysis with FlowJo software (TreeStar, Cupertino, Calif.).

Single B-Cell RT-PCR and Subsequent Sequencing and Cloning.

For each sorted cell, the IgG heavy and the corresponding Ig light chain gene transcripts were amplified by RT-PCR and cloned into eukaryotic expression vectors to produce full IgG1 antibodies. The frozen plates with single B-cell RNA were thawed at room temperature, and the RT reaction was carried out by adding 3 µl of random hexamers at 150 ng/µl, 2 µl of dNTP mix, each at 10 mM, and 1 µl of SuperScript III (Invitrogen) into each well. The thermocycle program for RT was 42° C. for 10 min, 25° C. for 10 min, 50° C. for 60 min and 94° C. for 5 min. The cDNA plates were stored at -20° C., and the IgH, Igκ and Igλ variable region genes were amplified independently by nested PCR starting from 5 µl of cDNA as template. All PCRs were performed in 96-well PCR plates in a total volume of 50 µl containing water, 5 µl of 10× buffer, 1 µl of dNTP mix, each at 10 mM, 1 µl of MgCl2 at 25 mM (Qiagen) for 1st round PCR or 10 µl 5× Q-Solution (Qiagen) for 2nd round PCR, 1 µl of primer or primer mix for each direction at 25 µM, and 0.4 µl of HotStar Taq DNA polymerase (Qiagen). Each round of PCR was initiated at 94° C. for 5 min, followed by 50 cycles of 94° C. for 30 sec, 58° C. for IgH and Igκ or 60° C. for Igλ for 30 sec, and 72° C. for 1 min, followed by 72° C. for 10 min. The positive 2nd round PCR products were cherry-picked for direct sequencing with both forward and reverse PCR primers. PCR products that gave a productive IgH, Igκ or Igλ rearranged sequence were re-amplified from the 1st round PCR using custom primers containing unique restriction digest sites and subsequently cloned into the corresponding Igγ1, Igκ and Igλ expression vectors. The full-length IgG1 was expressed by cotransfection of 293F cells with equal amounts of the paired heavy and light chain plasmids, and purified using a recombinant protein-A column (GE Healthcare).

IgG Gene Family Analysis.

The IgG heavy and light chain nucleotide sequences of the variable region were analyzed with JoinSolver (Joinsolver.niaid.nih.gov) and using the IMGT database (imgt.cines.fr).

Normal donor peripheral blood data originated from 120 IgD+CD27+ and 97 IgD-CD27+ sequences pooled for heavy chain analysis and 167 mutated IgM+ sequences for kappa chain analysis. The VRC mAb VK gene use was 11 determined by homology to germline genes in the major 2p11.2 IGK locus. VRC mAb D gene use was determined by homology to genes in the major 14q32.33 IGH locus.

Env and CCR5 Cell Surface Staining.

293T cells were transfected with plasmid DNA encoding JRFL Env to express the envelope glycoprotein on the cell surface. Cells were stained with anti-Env mAbs. The FACS signal was generated by adding a secondary antibody, goat anti-human IgG F(ab')2 conjugated with phycoerythrin (SouthernBiotech), at 1:125. Data were collected using flow cytometry with the BD LSR Flow Cytometer, and binding curves were generated by plotting the mean fluorescence intensity (MFI) as a function of antibody concentration. To assess gp120 binding to CCR5 on the surface of cells, biotinylated gp120 was used at 5 µg/ml to stain the CCR5 expressing canine thymus cell line, Cf2Th/syn CCR5. Prior to the staining of Cf2Th/syn CCR5 cells, biotinylated gp120 was incubated with ligands including CD4-Ig, VRC01, VRC02, VRC03 and b12 at serial concentrations ranging from 0.04-25 µg/ml. A streptavidin-APC conjugate (Invitrogen) was used at 1 µg/ml to stain Cf2Th/syn CCR5 cells to generate FACS signal, and binding data were collected using flow cytometry with the BD LSR Flow Cytometer. All the staining and incubations were carried out at room temperature for 1 hour.

Statistical Analysis.

Statistical analyses were performed using GraphPad Prism version 5.0 (GraphPad Software Inc.). A two-sided Fisher's Exact Test at alpha=0.05 was used for assessing the relationship between the viral sensitivity to serum 45 IgG and to VRC01. Among the viruses that were sensitive to both, Deming Regression was used to model the relationship on the log 10 scale, allowing for measurement error in the IC50s for both the serum IgG and the mAb. These models were run under the assumption of equal error variance. As a sensitivity analysis, the regression models were rebuilt with an estimated variance ratio; although the slope estimate changed slightly, the conclusions were consistent.

The amino acid sequences of the heavy and light chains of VRC01, VRC02 and VRC03 are shown below (SEQ ID NOs: 1-4, 27 and 28). Bold residues indicate the locations of the CDRs. Exemplary nucleic acid sequences encoding the heavy and light chains of VRC01, VRC02 and VRC03 (SEQ ID NOs: 29-34) are also shown below.

```
VRC01 Heavy Chain (SEQ ID NO: 1):
QVQLVQSGGQMKKPGESMRISCRASGYEFIDCTLNWIRLAPGKRPEWMGWLKPRGGAVNYARPL

QGRVTMTRDVYSDTAFLELRSLTVDDTAVYFCTRGKNCDYNWDFEHWGRGTPVIVSS

VRC01 Light Chain (SEQ ID NO: 2):
EIVLTQSPGTLSLSPGETAIISCRTSQYGSLAWYQQRPGQAPRLVIYSGSTRAAGIPDRFSGSRWGPDY

NLTISNLESGDFGVYYCQQYEFFGQGTKVQVDIKR

VRC02 Heavy Chain (SEQ ID NO: 3):
QVQLVQSGGQMKKPGESMRISCQASGYEFIDCTLNWVRLAPGRRPEWMGWLKPRGGAVNYARPL

QGRVTMTRDVYSDTAFLELRSLTADDTAVYYCTRGKNCDYNWDFEHWGRGTPVTVSS

VRC02 Light Chain (SEQ ID NO: 4):
EIVLTQSPGTLSLSPGETAIISCRTSQYGSLAWYQQRPGQAPRLVIYSGSTRAAGIPDRFSGSRWGPDY

NLTIRNLESGDFGLYYCQQYEFFGQGTKVQVDIKR
```

-continued

VRC03 Heavy Chain (SEQ ID NO: 27):
QVQLVQSGAVIKTPGSSVKISCRASGYNFRDYSIHWVRLIPDKGFEWIGWIKPLWGAVSYARQLQG

RVSMTRQLSQDPDPDWGVAYMEFSGLTPADTAEYFCVRRGSCDYCGDFPWQYWGQGTVVVSS

VRC03 Light Chain (SEQ ID NO: 28):
EIVLTQSPGILSLSPGETATLFCKASQGGNAMTWYQKRRGQVPRLLIYDTSRRASGVPDRFVGSGSG

TDFFLTINKLDREDFAVYYCQQFEFFGLGSELEVH

VRC01 Heavy Chain (SEQ ID NO: 29):
CAGGTGCAGCTGGTGCAGTCTGGGGGTCAGATGAAGAAGCCTGGCGAGTCGATGAGAATTTCTT

GTCGGGCTTCTGGATATGAATTTATTGATTGTACGCTAAATTGGATTCGTCTGGCCCCCGGAAAA

AGGCCTGAGTGGATGGGATGGCTGAAGCCTCGGGGGGGGCCGTCAACTACGCACGTCCACTTC

AGGGCAGAGTGACCATGACTCGAGACGTTTATTCCGACACAGCCTTTTTGGAGCTGCGCTCGTTG

ACAGTAGACGACACGGCCGTCTACTTTTGTACTAGGGGAAAAAACTGTGATTACAATTGGGACT

TCGAACACTGGGGCCGGGGCACCCCGGTCATCGTCTCATCACC

VRC01 Light Chain (SEQ ID NO: 30):
GAAATTGTGTTGACACAGTCTCCAGGCACCCTGTCTTTGTCTCCAGGGGAAACAGCCATCATCTC

TTGTCGGACCAGTCAGTATGGTTCCTTAGCCTGGTATCAACAGAGGCCCGGCCAGGCCCCCAGGC

TCGTCATCTATTCGGGCTCTACTCGGGCCGCTGGCATCCCAGACAGGTTCAGCGGCAGTCGGTGG

GGGCCAGACTACAATCTCACCATCAGCAACCTGGAGTCGGGAGATTTTGGTGTTTATTATTGCCA

GCAGTATGAATTTTTTGGCCAGGGGACCAAGGTCCAGGTCGACATTAAGCGA

VRC02 Heavy Chain (SEQ ID NO: 31):
CAGGTGCAGCTGGTGCAGTCTGGGGGCCAGATGAAGAAGCCTGGCGAGTCGATGAGAATTTCTT

GTCAGGCTTCCGGATATGAATTTATTGATTGTACACTAAATTGGGTTCGCCTGGCCCCCGGAAGA

AGGCCTGAATGGATGGGATGGCTGAAGCCTCGAGGGGGGCCGTCAACTACGCACGTCCACTTC

AAGGCAGAGTGACCATGACTCGAGACGTGTATTCCGACACAGCCTTTTTGGAGCTGCGCTCCTTG

ACAGCAGACGACACGGCCGTCTACTATTGTACTAGGGGAAAAAATTGTGATTACAATTGGGACT

TCGAACACTGGGGCCGGGGTACCCCGGTCACCGTCTCATCA

VRC02 Light Chain (SEQ ID NO: 32):
GAAATTGTGTTGACACAGTCTCCAGGCACCCTGTCTTTGTCTCCAGGGGAAACAGCCATCATCTC

TTGTCGGACCAGTCAGTATGGTTCCTTAGCCTGGTATCAACAGAGGCCCGGCCAGGCCCCCGGC

TCGTCATCTATTCGGGCTCTACTCGGGCCGCAGGCATCCCAGACAGGTTCAGCGGCAGTCGGTGG

GGGCCAGACTACAATCTCACCATCAGGAACCTGGAGTCGGGAGATTTTGGTCTTTATTATTGCCA

GCAGTATGAATTTTTTGGCCAGGGGACCAAGGTCCAGGTCGACATTAAGCGA

VRC03 Heavy Chain (SEQ ID NO: 33):
CAGGTGCAGCTGGTGCAGTCTGGGGCTGTGATTAAGACGCCTGGGTCCTCAGTGAAGATCTCAT

GTCGGGCTTCTGGATACAACTTTCGTGATTATTCGATCCATTGGGTCCGCCTCATTCCTGACAAG

GGATTTGAGTGGATTGGATGGATTAAACCTCTGTGGGTGCCGTCAGTTATGCCCGGCAACTTCA

GGGCCGAGTCTCTATGACTCGACAATTATCTCAAGACCCAGACGACCCGGACTGGGGCGTTGCC

TACATGGAGTTCAGTGGACTGACGT/CCCGCCGACACGGCCGAATATTTTTGTGTCCGGAGAGGG

TCCTGTGATTATTGCGGAGACTTTCCCTGGCAATACTGGGGTCAGGGCACCGTCGTCGTCGTCTC

GTCA

VRC03 Light Chain (SEQ ID NO: 34):
GAAATTGTGTTGACGCAGTCTCCCGGCATCCTGTCTCTGTCTCCAGGAGAGACAGCCACCCTCTT

TTGTAAGGCCAGTCAGGGTGGCAATGCTATGACGTGGTATCAGAAGAGACGTGGCCAGGTTCCC

AGACTCCTGATCTACGATACATCTCGCAGGGCCTCTGGCGTTCCTGACAGATTTGTTGGCAGTGG

-continued

```
GTCTGGGACAGACTTCTTTCTCACGATCAACAAATTGGACCGGGAAGATTTCGCAGTCTATTATT

GTCAACAATTTGAATTTTTTGGCCTGGGGAGCGAGCTGGAAGTCCATCGA
```

Example 2

Characterization of the Atomic Structure of VRC01 and gp120

This example describes the crystal structure for one of the VRC01 antibody in complex with an HIV-1 gp120 core. As disclosed herein the molecular basis of VRC01 neutralization is deciphered. In addition the mechanisms of natural resistance of HIV are identified and it shown how VRC01 minimizes such resistance.

To gain a structural understanding of VRC01 neutralization the antigen-binding fragment (Fab) of VRC01 was crystallize in complex with an HIV-1 gp120 from the clade A/E recombinant 93TH057. The crystallized gp120 consisted of its inner domain-outer domain core, with truncations in the variable loops V1/V2 and V3 as well as the N- and C-termini, which are regions known to extend away from the main body of the gp120 envelope glycoprotein. Diffraction to 2.9 Å resolution was obtained from orthorhombic crystals, which contained four copies of the VRC01-gp120 complex per asymmetric unit, and the structure was solved by means of molecular replacement and refined to a crystallographic R value of 19.7% (FIG. 26 and FIG. 47, Table S1).

The interaction surface between VRC01 and gp120 encompasses almost 2500 Å2, with 1244 Å2 contributed by VRC01 and 1249 Å2 by gp120. On VRC01, both heavy chain (894 Å2) and light chain (351 Å2) contribute to the contact surface (FIG. 48, Table S2), with the central focus of binding on the heavy chain-second complementarity-determining region (CDR H2). Over half of the interaction surface of VRC01 (644 Å2) involves CDR H2, a mode of binding that is reminiscent of the interaction between gp120 and the CD4 receptor; CD4 is a member of the V-domain class of the immunoglobulin superfamily, and the CDR2-like region of CD4 is a central focus of gp120 binding (FIG. 27A and FIG. 49, Table S3). For CD4, the CDR2-like region forms antiparallel, intermolecular hydrogen bonds with residues 365gp120 to 368gp120 of the CD4-binding loop of gp120 (FIG. 27B); with VRC01, one hydrogen bond is observed between the carbonyl oxygen of Gly54VRC01 and the backbone nitrogen of Asp368gp120. This hydrogen bond occurs at the loop tip, an extra residue relative to CD4 is inserted in the strand, and the rest of the potential hydrogen bonds are of poor geometry or distance (FIG. 27C and FIG. 50, Table S4). Other similarities and differences with CD4 are found: Of the two dominant CD4 residues (Phe43CD4 and Arg59CD4) involved in interaction with gp120, VRC01 mimics the arginine interaction but not the phenylalanine one (FIGS. 27, B and C). Lastly, substantial correlation was observed between gp120 residues involved in binding VRC01 and CD4 (FIG. 32).

Superposition of the gp120 core in its VRC01-bound form with gp120s in other crystalline lattices and bound by other ligands indicates a CD4-bound conformation [Protein Data Bank (PDB) ID number 3JWD] to be most closely related in structure, with a Ca-root-mean-square deviation of 1.03 Å (FIG. 51, Table S5). Such superposition of gp120s from CD4- and VRC01-bound conformations brings the N-terminal domain of CD4 and the heavy chain-variable domain of VRC01 into close alignment (FIG. 27), with 73% of the CD4 N-terminal domain volume overlapping with VRC01. This domain overlap is much higher than observed with the heavy chains of other CD4-binding-site antibodies, such as b12, b13, or F105 (FIG. 52, Table S6). However, when the VRC01 heavy chain is superimposed—on the basis of conserved framework and cysteine residues—on CD4 in the CD4-gp120 complex, clashes are found between gp120 and the entire top third of the VRC01 variable light chain (FIG. 27D). In its complex with gp120, VRC01 rotates 43° relative to the CD4-defined orientation and translates 6 Å away from the bridging sheet, to a clash-free orientation that mimics many of the interactions of CD4 with gp120, although with considerable variation. Analysis of electrostatics shows that the interaction surfaces of VRC01 and CD4 are both quite basic, although the residue types of contacting amino acids are distinct (FIG. 33). Thus, although VRC01 mimics CD4 binding to some extent, considerable differences are observed.

When CD4 is placed into an immunoglobulin context by fusing its two N-terminal domains to a dimeric immunoglobulin constant region, it achieves reasonable neutralization. VRC01, however, neutralizes more effectively (FIG. 28A). To understand the structural basis for the exceptional breadth and potency of VRC01, its interactive surface with gp120 was analyzed. VRC01 focuses its binding onto the conformationally invariant outer domain, which accounts for 87% of the contact surface area of VRC01 (FIG. 53, Table S7). The 13% of the contacts made with flexible inner domain and bridging sheet are noncontiguous, and it was noted that these were not critical for binding. In contrast, CD4 makes 33% of its contacts with the bridging sheet, and many of these interactions are essential. The reduction in inner domain and bridging sheet interactions by VRC01 is accomplished primarily by a 6 Å translation relative to CD4, away from these regions; critical contacts such as made by Phe43CD4 to the nexus of the bridging sheet-outer domain are not found in VRC01, whereas those to the outer domain (such as Arg59CD4) are mimicked by VRC01.

To determine the affinity of VRC01 for gp120 in CD4-bound and non-CD4-bound conformations, surface-plasmon resonance spectroscopy was used to measure the affinity of VRC01 and other gp120-reactive antibodies and ligands to two gp120s: a b4-deletion that is restrained from assuming the CD4-bound conformation or a disulfidestabilized gp120 core that is largely fixed in the CD4-bound conformation in the absence of CD4 itself (FIG. 28B and FIG. 34). VRC01 showed high affinity to both CD4-bound and non-CD4-bound conformations, which is a property shared by the broadly neutralizing b12 antibody. In contrast, antibodies F105 and 17b as well as soluble CD4 showed strong preference for either one, but not both, of the conformations. To assess the binding of VRC01 in the context of the functional viral spike, its ability to neutralize variants of HIV-1 with gp120 changes that affect the ability to assume the CD4-bound state was examined. Two of these mutations, His66Ala gp120 and Trp69Leugp120, are less sensitive, whereas a third, Ser375Trpgp120, is more sensitive to neutralization by CD4. VRC01 neutralized all three of these variant HIV-1 viruses with similar potency (FIG. 28C), suggesting that VRC01 recognizes both CD4-bound and non-CD4-bound conformations of the viral spike. This diversity in recognition allows VRC01 to avoid the conformational masking that hinders most CD4-binding-site ligands and to potently neutralize HIV-1. Precise targeting by VRC01. Prior analysis of effective and ineffective CD4-binding-site antibodies suggested that precise targeting to the vulnerable site of initial CD4 attachment is required to block viral entry. This site represents the outer domain contact for CD4. Analysis of the VRC01 interaction with gp120 shows that it covers 98% of this site (FIGS. 29, A and B, and FIG. 35), comprising 1089 Å2 on the gp120 outer domain, which is about 50% larger than the 730 Å2 surface covered by CD4. The VRC01 contact surface outside the target site is largely limited to the conformationally invariant outer domain and avoids regions of conformational flexibility. This concordance of binding is much greater than for ineffective CD4-binding-site antibodies as well as for those that are partially effective, such as antibody b12 (FIG. 35). The outer domain-contact site for CD4 is shielded by glycan. Contacts by the VRC01 light chain (Tyr28VRC01 and Ser30VRC01) are made with the protein-proximal N-acetylglucosamine from the N-linked glycan at residue 276gp120. Thus instead of being occluded by glycan, VRC01 makes use of a glycan for binding. Other potential glycan interactions may occur with different strains of HIV-1 because the VRC01 recognition surface on the gp120-outer domain extends further than that of the functionally constrained CD4 interaction surface, especially into the loop D and the often-glycosylated V5 region (FIG. 36).

In addition to conformational masking and glycan shielding, HIV-1 resists neutralization by antigenic variation. To understand the basis of this natural resistance to VRC01, 17 resistant isolates were analyzed all by threading their sequences onto the gp120 structure (FIG. 36). Variation was observed in the V5 region in resistant isolates, and this variation along with alterations in gp120 loop D appeared to be the source of most natural resistance to VRC01 (FIG. 29C and FIGS. 36 and 37).

Because substantial variation exists in V5, structural differences in this region might be expected to result in greater than 10% resistance. The lower observed frequency of resistance suggests that VRC01 employs a recognition mechanism that allows for binding despite V5 variation. Examination of VRC01 interaction with V5 shows that VRC01 recognition of V5 is considerably different from that of CD4 (FIG. 38), with Arg61VRC01 in the CDR H2 penetrating into the cavity formed by the V5 and b24 strands of gp120 (FIG. 39). The V5 loop fits into the gap between heavy and light chains; thus, by contacting only the more conserved residues at the loop base, VRC01 can tolerate variation in the tip of the V5 loop (FIG. 29D).

Examination of the structure of VRC01 was conducted for special features that might be required for its function. A number of unusual features were apparent, including a high degree of affinity maturation, an extra disulfide bond, a site for N-linked glycosylation, a two-amino-acid deletion in the light chain, and an extensively matured binding interface between VRC01 and gp120 (FIG. 30 and FIG. 40). The frequency with which these features were found in HIV-1 Env-reactive antibodies or in human antibody-antigen complexes was assessed (FIG. 41, FIG. 54, Table S8 and FIG. 55, Table S9) and measured the effect of genomic reversion of these features on affinity for gp120 and neutralization of virus (FIG. 30, A to D, and FIGS. 56 and 57, Table S10).

Higher levels of affinity maturation have been reported for HIV-1-reactive antibodies in general and markedly higher levels for broadly neutralizing ones. These maturation levels could be a by-product of the persistent nature of HIV-1 infection and may not represent a functional requirement. Removal of the N-linked glycosylation or the extra disulfide bond, which connects CDR H1 and H3 regions of the heavy chain, had little effect on binding or neutralization (FIGS. 30, A and B, and FIGS. 56 and 57, Table S10). Insertion of two amino acids to revert the light chain deletion had moderate effects, which were larger for an Ala-Ala insertion (50-fold decrease in binding affinity) versus a Ser-Tyr insertion (five-fold decrease in affinity), which mimics the genomic sequence (FIG. 30C and FIGS. 56 and 57, Table S10). Lastly, reversion of the interface was examined with either single-, four-, seven- or 12-mutant reversions. For the single-mutant reversions of the interface to the genomic antibody sequence, all 12 mutations had minor effects [most with a less than two-fold effect on the dissociation constant (Kd), with the largest effect for a Gly54Ser change having a Kd of 20.2 nM] (FIGS. 56 and 57, Table S10). Larger effects were observed with multiple (four, seven, or 12) changes (FIG. 30D and FIGS. 56 and 57, Table S10). Thus, although VRC01 has a number of unusual features, no single alteration to genomic sequence substantially altered binding or neutralization.

The probability for elicitation of a particular antibody is a function of each of the three major steps in B cell maturation: (i) recombination to produce nascent antibody heavy and light chains from genomic VH-D-J and Vk/l-J precursors, (ii) deletion of auto-reactive antibodies, and (iii) maturation through hypermutation of the variable domains to enhance antigen affinity. For the recombination step, a lack of substantial CDR L3 and H3 contribution to the VRC01-gp120 interface (FIG. 48, Table S2) indicates that specific Vk/l-J or VH(D)J recombination is not required (FIG. 42). The majority of recognition occurs with elements encoded in single genomic elements or cassettes, suggesting that specific joining events between them are not required. Within the VH cassette, a number of residues associated with the IGHV1-02*02 precursor of VRC01 interact with gp120; many of these are conserved in related genomic VHs, some of which are of similar genetic distance from VRC01 (FIGS. 43 and 44). These results suggest that appropriate genomic precursors for VRC01 are likely to occur at a reasonable frequency in the human antibody repertoire.

Recombination produces nascent B cell-presented antibodies that have reactivities against both self and nonself antigens. Those with autoreactivity are removed through clonal deletion. With many of the broadly neutralizing antibodies to HIV-1, such as 2G12 (glycan reactive) (33, 34), 2F5, and 4E10 (membrane reactive), this appears to be a major barrier to elicitation. Although this remains to be characterized for genomic revertants and maturation intermediates, no autoreactivity has so far been observed with VRC01.

The third step influencing the elicitation of VRC01-like antibodies is affinity maturation, which is a process that involves the hypermutation of variable domains combined with affinity-based selection that occurs during B cell maturation in germinal centers. In the case of VRC01, 41 residue alterations were observed from the genomic VH gene and 25 alterations from the Vk gene (including a deletion of two residues) (FIG. 45). To investigate the effect of affinity maturation on HIV-1 gp120 recognition, the VH and Vk regions of VRC01 were reverted, either individually or together, to the sequences of their genomic precursors. The affinity and neutralization of these reverted antibodies was tested (FIG. 31A) and this data was combined with the genomic reversion data obtained while querying the unusual molecular features of VRC01 (FIG. 31B). No antibodies containing VH and Vk regions, which were fully reverted to their genomic precursors, bound gp120 or neutralized virus. Binding affinity and neutralization showed significant correlations with the number of affinity matured residues (P<0.0001). Binding to stabilized gp120 did not correlate well with other types of gp120 or to neutralization (FIG. 58, Table S11), which is related in part to greater retention of binding to VRC01 variants with genomically reverted Vk regions. Extrapolation of the correlation to the putative genomic V gene sequences predicted binding affinities of 0.7 T 0.4 mM Kd for gp120 stabilized in the CD4-bound conformation and substantially weaker affinities for nonstabilized gp120s (FIG. 31B and FIG. 46).

No single affinity maturation alteration appeared to affect affinity by more than ten-fold, suggesting that affinity maturation occurs in multiple small steps, which collectively enable tight binding to HIV-1 gp120. When the effects of VRC01 affinity maturation reversions are mapped to the structure of the VRC01-gp120 complex, they are broadly distributed throughout the VRC01 variable domains rather than focused on the VRC01-gp120 interface. Noncontact residues therefore appear to influence the interface with gp120 through indirect protein-folding effects. Thus, for VRC01 the process of affinity maturation entails incremental changes of the nascent genomic precursors to obtain high-affinity interaction with the HIV-1 Env surface. Receptor mimicry and affinity maturation. The possibility that antibodies use conserved sites of receptor recognition to neutralize viruses effectively has been pursued for several decades. The recessed canyon on rhinovirus that recognizes the unpaired terminal immunoglobulin domains of intercellular adhesion molecule-1 highlights the role that a narrow canyon entrance may play in such occlusion of bivalent antibody combining regions, although framework recognition can in some instances permit entry. Partial solutions such as those presented by antibody b12 (neutralization of ~40% of circulating isolates) or by antibody HJ16 (neutralization of ~30% of circulating isolates), a recently identified CD4-binding-site antibody, may allow recognition of some HIV-1 isolates.

Materials and Methods

Expression and Purification of HIV-1 gp120 Proteins.

The codon-optimized plasmid pVRC8400-HIV-1 Clade A/E 93TH057 ΔV123 contains gp120 residues 44-492 with specific deletions at the V1/V2 and V3 regions. The expression construct was made by inserting mouse interleukin-2 (IL-2) leader sequence (MYSMQLASCVTLTLVLLVN, SEQ ID NO: 36) followed by the modified gp120 sequence between the 5' XbaI and 3' BamHI sites. In the modified gp120 sequence, N-term residues 31-43 of wild type Clade A/E 93TH057 gp120 were trimmed, amino acids sequences $^{124}$PLCVTLHCTTAKLTNVTNITNVPNIG-NITDEVRNCSFNMTTEIRDKKQKVHAL-FYKLDIVQIEDKN DSSKYRLINCNT$^{198}$ (SEQ ID NO: 37) of the V1/V2 loop and $^{302}$NMRTSMRIGPGQVFYRTG-SIT$^{323}$ (SEQ ID NO: 38) of the V3 loop were replaced with GG and GGSGSG (SEQ ID NO: 39) linkers, respectively. YU2 Δβ4 core gp120 was constructed with YU2 gp120 sequence by replacing the 9 residues of β3-β5 loop with a Gly-Gly linker This deletion weakens the binding of CD4 and prohibits formation of the antibody 17b epitope. The 93TH057, YU2Δβ4 core gp120 and HXBc2 Ds12F123 core gp120 were expressed and purified. Briefly 1L of HEK 293 GnTi- or 293 FreeStyle cells were transiently transfected with the mixture of 500 µg of gp120 DNA plasmid and 1 ml of 293fectin (Invitrogen). The transfected cells were incubated in FreeStyle 293 expression medium (Invitrogen) supplemented with 3% Cell Boost (HyClone) and 2 mM Butyrate (SIGMA) for suspension culture at 8% CO2, 37.0° C. and 125 rpm for five days after transfection. The supernatants for 93TH057 and HXBc2 Ds12F123 5 core gp120 were harvested and proteins purified with a protein A-immobilized 17b antibody affinity column. The YU2Δβ4 core gp120 was purified with a protein A-immobilized F105 antibody affinity column. The gp120 proteins were eluted with IgG elution buffer (Pierce) and immediately adjusted to pH 7.5.

Production of VRC01 IgG and Antigen-Binding Fragment.

The VRC01 IgG was expressed and purified. Briefly, heavy and light chain plasmids were transfected into 293F cells using 293Fectin (Invitrogen). The supernatant was harvested 5 days after transfection, filtered through 0.45 µm filter, and followed by purification using immobilized protein A or protein G columns. To produce antigen-binding fragments (Fab), VRC01 IgG was incubated at 37° C. with protease Lys-C (Roche) at a ratio IgG:LysC=4000:1 (w/w) in 10 mM EDTA, 100 mM Tris/Cl—, pH 8.5 for about 12 hours. Uncleaved IgG and the constant fragment (Fc) were removed by passing the digestion mixture through a Protein A affinity column; the flowthrough containing VRC01 Fab was concentrated and loaded onto size-exclusion column (Superdex 5200) for further purification.

Deglycosylation, Complex Formation and Crystallization of the gp120:VRC01 Complexes.

Deglycosylation of HIV-1 gp120 was performed in a reaction solution containing 1-5 mg/ml gp120, 350 mM NaCl, 100 mM Na Acetate, pH 5.9, 1×EDTA-free protease inhibitor (Roche) and endoglycosidase H (30 units/µg of gp120). After mixing all components and adjusting pH to 5.9, the solution was incubated at 37° C. and the deglycosylation process was monitored by SDS-PAGE until completion. gp120:VRC01 complexes were made. Briefly, VRC01 Fab in 20% molar excess was combined with deglycosylated gp120 and the gp120:VRC01 mixture was passed through a concanavalin A column to remove gp120 with uncleaved N-linked glycans. The complex was then purified by size exclusion chromatography (Hiload 26/60 Superdex S200 prep grade, GE Healthcare) and concentrated to ~10 mg/ml in 0.35 M NaCl, 2.5 mM Tris pH 7.0, 0.02% NaN3 for crystallization screening studies. To achieve better chances of crystallization hits, two gp120 variants, clade B HxBc2 core Ds12F123 and clade A/E 93TH057, were used to make complexes with the VRC01 Fab. Commercially available screens, Hampton Crystal Screen (Hampton Research), Precipitant Synergy Screen (Emerald BioSystems), and Wizard Screen (Emerald BioSystems), were used for initial crystallization trials of the gp120: VRC01 complexes. Vapor-diffusion sitting drops were set up robotically by mixing 0.1 µl of protein with an equal volume of precipitant solutions (Honeybee, DigiLab). Droplets were allowed to equilibrate at 20° C. and imaged at scheduled times with RockImager (Formulatrix.). Multiple crystal hits were obtained from both HXBc2:VRC01 and 93TH057: VRC01 complexes. Those hits were optimized manually using the hanging drop vapor-diffusion method. Crystals of the HXBc2:VRC01 complex were obtained in 1.0 M NaCltrate, 100 mM NaCacodylate, pH 6.5. For the 93TH057: VRC01 complex, the best condition to obtain diffraction-quality crystals was 10% PEG 8000, 100 mM Tris/Cl—, pH 8.5 with 3% glucose as additive.

X-Ray Data Collection, Structure Determination and Refinement for the gp120:VRC01 Complex.

The diffraction of gp120:VRC01 crystals were tested under cryogenic conditions. To search for the best cryoprotectant, protecting effects of six commonly used cryoprotectants, 30% glycerol, 30% ethylene glycol, 15% 2R,3R-butanediol, 40% trihalose, 40% sucrose and 40% glucose, were assessed. Crystals were transferred into solutions which were composed of crystallization reservoir solution with 50% higher concentration of precipitant(s) and each individual cryo-protectant or mixture of cryo-protectants, immediately flash frozen in liquid nitrogen with a cryo-loop (Hampton Research) and mounted under cryo condition (100K°) for data collection. X-ray data were collected at beam-line ID-22 (SER-CAT) at the Advanced Photon Source, Argonne National Laboratory, with 0.82656 Å radiation, processed and reduced with HKL2000. None of the HXBc2:VRC01 crystals diffracted beyond 4 Å resolution and they were not used for data collection. A 2.9 Å data set for the 93TH057: VRC01 crystals was collected using a cryoprotectant solutions containing 15% PEG8000, 100 mM Tris/Cl—, pH 8.5 and 20% glucose and 7.5% 2R,3R-butanediol as cryoprotectants. I/σ ratio was 1.2 at the 2.9 Å shell with 68% completeness. The crystal structure of the 93TH057:VRC01 complex was solved by molecular replacement with Phaser in the CCP4 Program Suite. This crystal belonged to a space group P21 with cell dimensions a=108.6, b=98.3, c=205.3, β=99.7 and contained four molecules per asymmetric unit. The structure of 93TH057 gp120 with β20/β21 region trimmed (PDB #3M4M) was used as an initial model to place the gp120 in the complex. Phaser was able to give a solution with three gp120s initially (RFZ=4.3 TFZ=4.7 PAK=0 LLG=69 RFZ=3.5 TFZ=11.8 PAK=0 LLG=234 RFZ=3.7 TFZ=17.5 PAK=0 LLG=485 LLG=1280). With those three gp120s fixed, the CDR-loop-trimmed variable domain (Fv) of antibody b13 (PDB ID 3I3DX) was used to locate the Fv portion of VRC01 in the complex (RFZ=3.7 TFZ=11.7 PAK=0 LLG=539 RFZ=3.9 TFZ=5.0 PAK=0 LLG=389 RFZ=3.9 TFZ=4.7 PAK=0 LLG=136 LLG=428). Visual inspection of the generated gp120:Fv solutions identified one of gp120s complexed with a symmetry-operated Fv. This new gp120:Fv complex was used as model to perform a new round of molecular replacement, one complex at a time, until all four gp120:Fv complexes were found (Round 1: RFZ=6.6 TFZ=8.9 PAK=0 LLG=72 LLG=243, Round 2: RFZ=5.9 TFZ=16.0 PAK=0 LLG=78 LLG=623, Round 3: RFZ=8.4 TFZ=25.3 PAK=0 LLG=739 LLG=1866, Round 4: RFZ=5.8 TFZ=22.8 PAK=0 LLG=990 LLG=2608). The constant domain of Fab b13 was then used to place one of the VRC01 constant domains with all four previous solutions fixed (RFZ=4.7 TFZ=21.5 PAK=1 LLG=1357 LLG=3313). The newly found constant domain and the gp120:Fv formed a complete gp120:VRC01 complex and the other three molecules were generated by superposing this complex with other three gp120s in the asymmetric unit. Further refinement was carried out with PHENIX. Starting with torsion-angle simulated annealing with slow cooling, iterative manual model building was carried out on Xtalview and COOT with maps generated from combinations of standard positional, individual B-factor, TLS refinement algorithms and non-crystallographic symmetry (NCS) restraints. Ordered solvents were added during each macro cycle. Throughout the refinement processes, a cross validation (Rfree) test set consisting of 5% of the data was used. Structure validations were performed periodically during the model building/refinement process with MolProbity and pdb-care. Even though the reported data at the highest shell of 2.9 Å only has I/σ ratio of 1.2, reflections up to 2.7 Å resolution (I/σ>1.0, ~30% completeness) were included and used during the refinement. X-ray crystallographic data and refinement statistics are summarized in FIG. 47, Table S1.

Surface Plasmon Resonance (SPR).

The binding kinetics of HIV-1 gp120 with different ligands were performed on Biacore 3000 or Biacore T-100 (GE Healthcare) at 20° C. with buffer HBS-EP+ (10 mM HEPES, pH 7.4, 150 mM NaCl, 3 mM EDTA, and 0.05% surfactant P-20). To assess VRC01 recognition of gp120 in the CD4-bound and non-CD4-bound conformation, gp120 molecules (YU2Δβ4 core and HXBc2 Ds12F123 core) were immobilized onto a CM5 chip to 250-500 response units (RUs) with standard amine coupling; Fab antibodies, CD4 or CD4-Ig-αTP at 2-fold increasing concentrations were injected over the gp120 channels at a flow rate of 30 μl/min for 3 minutes and allowed to dissociate for another 5-10 minutes before regeneration with two 25 μl injections of 4.5 M MgCl2 at a flow rate of 50 μl/ml. To test the effects of mutations on VRC01, IgG variants were captured with a mouse anti-human IgG Fc antibody supplied in the "human antibody capture kit" (GE Healthcare) to a surface density about 300 RUs. gp120 series with 2-fold increasing concentrations were passed over the captured IgG flow channels for 3 minutes and allowed to dissociate for another 5-10 minutes at a flow rate of 30 μl/min. The sensor chip was regenerated after each experiment using two 25 μl injections of 4.5 M MgCl2 at a flow rate of 50 μl/ml. Sensorgrams were corrected with appropriate blank references and fit globally with Biacore Evaluation software using a 1:1 Langmuir model of binding. Sensorgrams of IgG b12 binding to gp120 could not be fitted with 1:1 Langmuir model and were analyzed with a 10 two-state binding model; such treatment should not affect the primary on-rates nor overall KDs reported here.

Mutagenesis and Creation of VRC01 Genomic Revertants.

Single-4-, 7-, 12-revertant mutations to germline residues of VRC01 as well as the heavy chain C32SC98A mutations, light chain insertions with Ala-Ala or Ser-Tyr after position 30 were listed in FIG. 59, Table S12 and the mutagenesis were carried out using Quikchange kit (Stratagene) according to manufacturer's protocol. V-gene revertants for VRC01 were constructed as follows: For heavy chain Vgene revertant (gH), VRC01 heavy chain V-gene region was reverted to its germline precursor IGHV 1-02*02. For light chain V-gene revertant (gL), VRC01 light chain Vgene region was reverted to its germline precursor IGKV 3-11*01. The modified heavy and light chain genes were synthesized by GeneArt (Regensburg, Germany), and cloned into a mammalian CMV/R vector for expression. All the VRC01 variants were expressed with the same protocol as wild type VRC01 IgG.

Neutralization Assays.

Neutralization Assays of Viruses by VRC01 and its Variants:

HIV-1 Env-pseudoviruses were prepared by transfecting 293T cells ($6\times10^6$ cells in 50 ml growth medium in a T-175 culture flask) with 10 μg of rev/env expression plasmid and 30 μg of an env-deficient HIV-1 backbone vector (pSG3ΔEnvelope), using Fugene 6 transfection reagents (Invitrogen). Pseudovirus-containing culture supernatants were harvested two days after transfection, filtered (0.45 μm), and stored at −80° C. or in the vapor 11 phase of liquid nitrogen. Neutralization was measured using HIV-1 Env-pseudoviruses to infect TZM-b1 cells as described previously. Briefly, 40 μl of virus was incubated for 30 min at 37° C. with 10 μl of serial diluted test antibody in duplicate wells of a 96-well flat bottom culture plate. To keep assay conditions constant, sham media was used in place of antibody in specified control wells. The virus input was set at a multiplicity of infection of approximately 0.01, which generally results in 100,000 to 400,000 relative light units (RLU) in a luciferase assay (Bright Glo, Promega, Madison, Wis.). The antibody concentrations were defined at the point of incubation with virus supernatant. Neutralization curves were fit by nonlinear regression using a 5-parameter hill slope equation. The 50% inhibitory concentrations (IC50) were reported as the antibody concentrations required to inhibit infection by 50%.

Neutralization Assay of Viruses with Altered Sampling of the CD4-Bound State by VRC01 and CD4.

Recombinant HIV-1 expressing the firefly luciferase gene was produced by calcium phosphate transfection of 293T cells with the molecular clone pNL4.3 (Env-) Luc and the pSVIIIenv plasmid expressing the wild-type or mutant HIV-1YU2 envelope glycoproteins at a weight ratio of 2:1. Two days after transfection, the cell supernatants were harvested. The reverse transcriptase activities of all virus preparations were measured. Each virus preparation was frozen and stored in aliquots at −80° C. until use. Luciferase-expressing viruses bearing either wild-type or mutant envelope glycoproteins were incubated for 1 hour at 37° C. with serial dilutions of sCD4 or VRC01 IgG in a total 12 volume of 200 µl. The recombinant viruses were then incubated with Cf2Th-CD4/CCR5 cells; luciferase activity in the cells was measured two days later.

ELISA Assay.

Clade A/E 93TH057 and clade B HXBc2 core Ds12F123 gp120 in PBS (pH 7.4) at 2 µg/ml were used to coat plates for 2 hours at room temperature (RT). The plates were washed five times with 0.05% Tween 20 in PBS (PBS-T), blocked with 300 µl per well of block buffer (5% skim milk and 2% bovine albumin in PBS-T) for 1 hour at RT. 100 µl of each monoclonal antibodies 5-fold serially diluted in block buffer were added and incubated for 1 hour at RT. Horseradish peroxidase (HRP)-conjugated goat anti-human IgG (H+L) antibody (Jackson ImmunoResearch Laboratories Inc., West Grove, Pa.) at 1:5,000 was added for 1 hour at RT. The plates were washed five times with PBS-T and then developed using 3,3',5,5'-tetramethylbenzidine (TMB) (Kirkegaard & Perry Laboratories) at RT for 10 min. The reaction was stopped by the addition of 100 µl N H2SO4 to each well. The readout was measured at a wavelength of 450 nm. All samples were performed in triplicate.

Analysis of the Commonality of VRC01 Features.

Structural Dataset for Analysis of Antibody Affinity Maturation:

Initially, the IMGT/3Dstructure-DB was searched for structures of human antibody-protein and antibody-peptide complexes of at most 3.5 Å resolution. This resulted in a set of 54 antibody-protein and 66 antibody-peptide structures (the 2wuc complex was found in both the protein and peptide databases). To complement the structure query, the RSCB PDB was searched for "human fab complex" and structure resolution of at most 3.5 Å, resulting in a set of 290 structure hits; 211 of these had not been identified as part of the IMGT/3Dstructure-DB search. All unique pdbs from the IMGT/3Dstructure-DB database and the PDB search were manually inspected. Additionally, two structures (2b4c and 3hi1, see FIG. 58, Table S11) not found in either search were also inspected. To be included in the affinity maturation analysis, pdbs had to possess the following properties: antibody-protein or antibody-peptide complex, IgG antibody of human origin, natural affinity maturation, and antigen not artificially modified for improved binding. In the cases where multiple complexes of the same antibody were identified, only one such complex was used for the analysis. As a result, only 26 of the complexes, shown in FIGS. 56 and 57, Table S10, were retained for the antibody affinity maturation analysis. The list of discarded pdbs, along with the specific reasons for discarding, is shown in FIG. 58, Table S11. For each of the selected 26 antibody complexes, the number of antibody contact residues that were mutated from germline was computed for the antibody V-segments. Contact residues were identified using PISA. Antibody germline genes were identified with IgBLAST (ncbi.nlm.nih.gov/igblast) using antibody protein sequences for the search; insertions/deletions were not counted toward the number of mutations from germline. A summary of the number of contact residues, V-segment mutated residues, and mutated contact residues for the 26 antibodies are shown in FIGS. 56 and 57, Table S10.

Analysis of cys Residues, Residue Deletions, and Glycan Additions:

A dataset of human HIV-1 antibody heavy and light chain sequences was obtained. The final curated version of that dataset that excluded non-specific gp140 14 binders as well as sequences with non-fully-resolved variable regions, included 147 heavy and 147 light chain sequences. Sequence alignment to germline was performed using IMGT/V-QUEST. The number of glycans was computed for the V-D-J heavy and V-J light regions. The number of Cys residues was computed for the V-D-J heavy regions only. The number of residue deletions was computed for the V-segments as compared to the corresponding germline; a deletion of multiple consecutive amino acids was counted as a single deletion.

Numbering of amino acid residues in antibody the Kabat nomenclature for amino acid sequences in antibodies was followed.

Protein structure analysis and graphical representations GRASP and APBS were used in calculations of molecular surfaces, volumes, and electrostatic potentials. PISA was used to perform protein-protein interfaces analysis. CCP4 was used for structural alignments. All graphical representation with protein crystal structures were made with Pymol.

Example 3

2F5 Antibody with Enhanced Neutralization Capacity

The membrane-proximal external region (MPER) of the HIV-1 gp41 transmembrane glycoprotein is the target of three broadly neutralizing anti-HIV-1 antibodies, 2F5, Z13e, and 4E10, and is thus a potential site of HIV-1 vulnerability to the humoral immune response. The MPER encompasses ~25 residues at the carboxyl-terminal end of the predicted gp41 ectodomain, just before the transmembrane region, and is rich in aromatic residues, typical of bilayer-interfacial regions of membrane proteins. Mutation of selected MPER tryptophans abrogates gp41-mediated fusion of the viral and target cell membranes, indicating that this region is crucial for HIV-1 infectivity. Structural studies of unbound forms of the gp41MPER both in solution and in lipid contexts have demonstrated that it adopts a number of conformations, many of which are _-helical, and electron-paramagnetic resonance measurements have indicated lipid bilayer immersion depths for MPER residues that range from acyl to phospholipid headgroup regions. The binding of neutralizing antibodies, such as 2F5, to the MPER must therefore account for the membrane milieu in which the epitope is found.

The 2F5 antibody has been shown to exhibit ~100-fold enhanced binding to its epitope on uncleaved gp140s when presented in the context of lipid proteoliposomes, and other studies have shown that 2F5 can contact phospholipids directly in the absence of gp41. The latter finding has led to the suggestion that 2F5 might be autoreactive, although passive transfusion of 2F5 does not appear to have deleterious effects and 2F5 failed to react in some clinically based assays for autoreactive lipid antibodies. The crystal structures of the 2F5 antibody in complex with its gp41MPER epitope revealed that, despite the 22-residue length of the 2F5 heavy chain third complementarity-determining region (CDR H3) loop, contacts with the gp41MPER peptide are made predominantly at the loop base. In some crystal structures, the tip of the loop protrudes away from gp41, while in others, it is disordered. A unique feature of the tip of the CDR H3 loop is that it contains a patch of hydrophobic residues, including residues L100A, F100B, V100D, and I100F (Kabat numbering), which, with the exception of I100F, do not contact gp41 (FIG. 62). While a prior study revealed the importance of residue F100B of the CDR H3 loop in 2F5-neutralizing activity, nonconservative residue substitutions at this position also appeared to diminish 2F5 binding to the immobilized MPER peptide and gp41 in enzyme-linked immunosorbent assay (ELISA) formats. Conversely, a more recent study has shown that alanine mutations in the 2F5 CDR H3 loop can affect neutralization without affecting gp41 binding As disclosed herein the role of the chemical nature of residues at the tip of the 2F5 CDR H3 loop in neutralization of HIV-1 is examined. Mutations were introduced into the 2F5 CDR H3 loop that altered its hydrophobicity, and the resulting 2F5 mutants were tested both for binding to a gp41 epitope peptide and for neutralization of HIV-1. The results showed that the tip of the 2F5 CDR H3 loop, and specifically its hydrophobic nature, is required for 2F5-mediated neutralization of HIV-1 by means that appear to be independent both of gp41 affinity and of isolatespecific sensitivity to neutralization by 2F5.

Materials and Methods
Antibodies.

The heavy and light chains of the 2F5 antibody were codon optimized for mammalian expression, synthesized, and transferred separately into the pVRC8400 (CMV/R) mammalian expression vector. Mutations within the 2F5 CDR H3 loop were analyzed for structural compatibility with neighboring residues and were then introduced into the 2F5 heavy-chain plasmid using standard site-directed mutagenesis techniques, implemented by ACGT, Inc., Chicago, Ill. The wild-type and mutant 2F5 heavy- and light-chain plasmids were transiently transfected into 293 Freestyle cells using 293fectin (Invitrogen), and supernatants containing secreted IgGs were harvested 72 to 96 h post transfection. The IgGs were purified by flowing the supernatants over a protein A-agarose column (Pierce), followed by elution with IgG elution buffer (Pierce).

Peptides.

A wild-type gp41MPER peptide corresponding to residues 657 to 669 of gp41 (HxB2 numbering) linked to a C-terminal C9 tag was used and was comprised of the sequence EQELLELDKWASLGGTETSQVAPA (SEQ ID NO: 40) (American Peptide).

Surface Plasmon Resonance.

Biacore 3000 (GE Healthcare) was used in tests. 2F5 wild-type and mutant IgGs were coupled directly to Biacore CM5 chips at final densities of ~4,000 to 5,000 response units (RU). The gp41MPER peptide was used as the analyte and flowed over at 2-fold serial dilutions ranging from 500 to 0.49 nM at a flow rate of 30 µl/min for 3 min, followed by injection of standard Biacore HEPES buffer (10 mM HEPES, pH 7.4, 150 mM NaCl, 3 mM EDTA, 0.01% P-20) for 3 min. Binding profiles were analyzed using either Biaevaluation software (GE Healthcare) or Scrubber version 2 (Biologic).

Virus Neutralization Assays.

A single-cycle infectivity assay using Env pseudotyped virus and Tzm-b1 target cells (NIH AIDS Research and Reference Reagent Program) was used to assess the neutralization capacities of the 2F5 variants. Env from the HIV-1 strains MN, HxB2, JR-FL, SC422661.8, RHPA4259.7, and TRO.11 were used, as were Env from the HIV-2 strain 7312a and the HIV-2-HIV-1 chimera 7312a-C1. Murine leukemia virus (MuLV) Env was used as a negative control.

Hydrophobicity Analysis.

Analysis of the free energies of partitioning the 2F5 CDR H3 loop tip into octanol or a lipid bilayer interface was performed using MPex 3.1 software (blanco.biomol.uci.edu/mpex). The analysis was performed on residues 100A to 100F of the 2F5 CDR H3 loop using the Totalizer function, with no end groups added and the ΔCONH value set at 0.

Statistical Analysis.

Statistical analyses were performed using GraphPad Prism version 5.0 (GraphPad Software Inc.) and Origin 7 (Originlab Corporation).

Results

Predictive measures of hydrophobicity, as determined by scales of free energy for partitioning whole residues from water to a lipid bilayer interface, $\Delta G_{wif}$, or to octanol, $\Delta G_{oct}$, were used to design mutations that would either disrupt or augment the predicted partitioning of the 2F5 CDR H3 tip (residues L100A to I100F) (FIG. 62). The amino acid serine, which is found midway on the $\Delta G_{wif}$ and $\Delta G_{oct}$ hydrophobicity scales, was chosen as a single or double substitution in order to achieve a gradual decrease in hydrophobicity (FIG. 62C and FIG. 63, Table 1). Conversely, tryptophan, which is the residue most favored to partition into the bilayer interface or octanol, was used to augment the hydrophobicity of the loop (FIG. 62C and FIG. 63, Table 1).

To ascertain the effect of the CDR H3 tip mutations on binding of 2F5 to the gp41MPER, the affinities of the expressed 2F5 variants for a gp41MPER peptide were determined using surface plasmon resonance. The 2F5 wild-type and mutant IgGs were coupled directly to the biosensor surface, and a gp41 MPER peptide comprised of residues 657 to 669 of gp41 (isolate HxB2 numbering) linked to a C-terminal C9 tag was used as analyte, at 2-fold serial dilutions ranging from 500 to 0.49 nM. As shown in FIG. 63, Table 1 (FIG. 72), all of the mutants maintained nanomolar affinity to the gp41 peptide. In some cases, such as for mutants of I100F, there was a moderate reduction in affinity, likely due to minor contacts made by this residue with gp41.

The 2F5 mutants were then tested for neutralization of the laboratory-adapted strain HxB2, which is highly sensitive to wild-type 2F5. A single-cycle infectivity assay using Env-pseudotyped virus and Tzm-b1 target cells was employed for this purpose. As shown in FIG. 64, top, even single replacements of hydrophobic residues of the CDR H3 loop with serine were able to reduce the neutralization capacity of 2F5 against HxB2 by several orders of magnitude. The most noticeable single mutation effect was observed for the F100BS mutation, which led to a more than 500-fold increase in the 50% inhibitory concentration (IC50) relative to wild-type 2F5 (FIG. 64, top, and FIG. 63, Table 1). The single mutations L100AS and I100FS likewise led to 100-fold increases in the IC50s, while the V100DS mutation increased the IC50 by about 15-fold. Introduction of double mutations to serine at the same residue locations, furthermore, led to complete abrogation of 2F5-mediated neutralization of HxB2, with neutralization profiles indistinguishable from those of the negative control mouse 1D4 anti-rhodopsin antibody (FIG. 64, middle, CDR H3 loop can reduce and completely disrupt 2F5 neutralization, despite maintaining nanomolar affinity for gp41.

Since these findings could be the result either of a disruption of specific protein contacts made by these residues or of a disruption of nonspecific interactions mediated by their chemical nature, mutation of the same CDR H3 residues to tryptophan was undertaken. Substitutions to tryptophan served two purposes: first, they augmented the hydrophobicity and predicted favorability of free energies of transfer from water to a bilayer interface or to octanol ($\Delta G_{wif}$ and $\Delta Goct$), and second, the bulky nature of the tryptophan side chain had the potential to disrupt protein-protein contacts, should they exist. When tested for neutralization of HxB2, the tryptophan mutants were either commensurate with 2F5 wild-type neutralization, such as $L100_AW$ and $F100_BW$, or were even more potent, such as $V100_DW$ and the double mutant $L100_AW$ $V100_DW$, both of which showed an ~10-fold decrease in the neutralization IC50 relative to wild-type 2F5 (FIG. 64, bottom).

To rule out the possibility that these results were specific to the HxB2 isolate, the 2F5 mutants were tested for neutralization of a panel of tier 1 and tier 2 HIV-1 isolates, ranging from highly sensitive strains, such as MN, to more resistant ones, such as JR-FL, and also to an HIV-2-HIV-1 2F5 epitope chimera, 7312a-C1. As shown in FIG. 63, Table 1, single mutations that decreased the hydrophobicity of the 2F5 CDR H3 loop led to decreases in neutralization potency, and double mutations that decreased hydrophobicity completely abrogated neutralization. Likewise, single and double mutations that increased the hydrophobicity of the loop led to increased neutralization potencies (FIG. 63, Table 1). Meanwhile, neutralization of the Tro.11 isolate, which has a K665S point mutation in the core of the epitope, was virtually undetectable for all 2F5 mutants, similar to what was observed for viruses pseudotyped with MuLV and parental HIV-2 7312a Env, which were used as negative controls.

To determine if there was a statistical relationship between the hydrophobicity of the 2F5 CDR H3 loop and the neutralization capacity of the antibody, neutralization IC50s of the 2F5 mutants were plotted against the estimated free energies of transfer, $\Delta G_{wif}$, of the mutant CDR H3s for each of the strains tested. As shown in FIG. 65A and FIG. 66, Table 2, with the exception of RHPA-4259, statistically significant linear relationships were observed between neutralization IC50s and CDR H3 $\Delta G_{wif}$, with P values ranging from 0.0012 for HxB2 to 0.018 for JR-FL. Linear relationships with even more stringent P values were observed between neutralization IC50s and the predicted free energy of transfer to octanol, $\Delta G_{oct}$ (FIG. 73A and FIG. 69, Table S1). Associations between the neutralization IC50s and the affinities of the various 2F5 mutants for gp41MPER peptide were also examined. As shown in FIG. 65B and FIG. 66, Table 2, despite the fact that the fits appear to be largely driven by the KD (dissociation constant) of the I100FS 2F5 mutant for gp41 (which makes minor contacts with the peptide), no statistically significant relationships were observed between the neutralization IC50s of the 2F5 CDR H3 variants and their affinities for the gp41MPER peptide.

Though the overall levels of the IC50s varied per strain tested, likely a reflection of the strain sensitivity to 2F5 itself, the mutations appeared to exhibit similar effects on neutralization regardless of the strain used. Specifically, no significant differences were observed in the slopes of the linear fits of the neutralization IC50s versus $\Delta G_{wif}$ or versus $\Delta G_{oct}$, unlike their y intercepts, which did display significant differences (FIG. 65A, and FIG. 66, Table 2). The similarities in the slopes of the regressions across all strains suggested that the neutralization effects mediated by 2F5 CDR H3 loop hydrophobicity were largely independent of strain sensitivity to 2F5. The free energy of antibody neutralization ($\Delta G^N$) can be viewed as a sum of free energies that contribute to its functional interactions with a specific strain of virus. It can also be viewed as a binding association of an antibody "n" with the virion: $\Delta G^N$-RT ln K(n), where K(n) is defined as IC50/f(n) and f(n) is a function that accounts for variables such as strain sensitivity and assay used. Although an absolute value for this free energy requires the definition of f(n), if f(n1) can be approximated to equal f(n2) for two variants n1 and n2 of the same antibody neutralizing the same strain of virus, a relative free energy, $\Delta\Delta G^N$, can be obtained. In the case of 2F5, it was verified how the free energy of partitioning the CDR H3 loop from water to a lipid bilayer interface, $\Delta G_{wif}$, or to octanol, $\Delta G_{oct}$, correlated with the relative free energy of neutralization ($\Delta\Delta G^N = \Delta G_{2F5wt}^N - \Delta G_{2F5mut}^N$). Linear models were used to fit curves of $\Delta\Delta G^N$ versus $\Delta G_{wif}$ (FIG. 65C) or $\Delta G_{oct}$ (FIG. 73C) for each individual strain and for all strains together. The shared correlations obtained were statistically significant, with P<0.0001, although end points at high hydrophobicity suggested linear fits might not be ideal (see below). Nonetheless, the results confirmed that the effects of $\Delta G_{wif}$ and $\Delta G_{oct}$ of the 2F5 CDR H3 loop on virus neutralization were largely independent of the virus strain, with the normalization relative to 2F5 wild type in the $\Delta\Delta G^N$ calculation making the fits for all the strains virtually superimposable (FIG. 65C and FIG. 73C). The shared slopes from these correlations were 1.3 and 1.2 for $\Delta G_{wif}$ and $\Delta G_{oct}$, respectively. Thus, the calculated change in the free energy of partitioning the 2F5 CDR H3 loop translates almost directly into changes in neutralization. The 30% enhancement in neutralization, $\Delta\Delta G^N$, over the calculated partition free energy may reflect the planar positioning of these residues in the CDR H3 structure and/or their positioning induced by recognition of the gp41 protein component.

Though linear regressions provided a reasonable first approximation of the relationship between neutralization IC50s and the free energy of hydrophobic transfer of the tip of the 2F5 CDR H3 loop, it was observed that beyond a certain threshold of loop hydrophobicity, the effects on neutralization appeared to level off. To account for this observation, a quadratic term was added to the linear regressions. This yielded better fits of the data, as judged by an extra sums-of-squares F test (FIG. 67A, FIG. 73B and FIG. 70, Table S2). Based on these quadratic models, IC50 minima were interpolated for each of the strains tested (FIG. 71, Table S3). On average, the interpolated minimum IC50s were approximately 0.96 log units or 9.2-fold lower than the corresponding experimental IC50s of wild-type 2F5 (FIG. 71, Table S3). Compared to the interpolated IC50s corresponding to a $\Delta G_{wif}$ of 0, in which no transfer is predicted to occur, the mean minimum IC50s were approximately 5.1 log units or 13,000-fold lower than those predicted for a 2F5 variant with no capacity for hydrophobic transfer (FIG. 71, Table S3). A quadratic term was also added to the fits of the plots of the relative free energies of neutralization, $\Delta\Delta G^N$, versus the predicted free energies of transfer of the 2F5 CDR H3 loop to a bilayer interface, $\Delta G_{wif}$, or octanol, $\Delta G_{oct}$ (FIG. 67B and FIG. 77D). Shared quadratic fits of $\Delta\Delta G^N$ versus $\Delta G_{wif}$ and $\Delta G_{oct}$ were also performed, and $\Delta\Delta G^N$ minima were observed at 2F5 CDR H3 $\Delta G_{wif}$ and $\Delta G_{oct}$ values of −4.08 and −5.69 kcal/mol, with corresponding $\Delta\Delta G^N$ values of −1.28 and −1.18 kcal/mol, respectively (FIG. 67C and FIG. 77D).

DISCUSSION

The results presented herein suggest that in addition to gp41MPER binding, interactions mediated by the tip of the 2F5 CDR H3 loop are also required for 2F5-mediated neutralization of HIV-1. For the elements of 2F5-mediated neutralization described here, the free energy of 2F5-mediated virus neutralization, $\Delta G^N$, can thus be viewed as the sum of the free energy of 2F5 structure-specific recognition of gp41 combined with the free energy of transfer of its CDR H3 loop into a hydrophobic milieu (FIG. 68). While a number of possibilities exist to explain how the tip of the 2F5 CDR H3 mediates neutralization of HIV-1, the finding that mutations to tryptophan were tolerated at three separate locations within the CDR H3 loop, in some cases even augmenting 2F5-mediated neutralization, is consistent with the loop mediating nonspecific hydrophobic interactions. It was surmised that such interactions are more likely to occur at a lipid bilayer interface than within a protein-protein interface, though 2F5 has been shown to tolerate a great deal of sequence variation at its interface with gp41. The finding that correlations of hydrophobicity of the loop and neutralization capacity are largely independent of HIV-1 isolate sensitivity to 2F5, furthermore, suggests that the contacts mediated by the 2F5 CDR H3 loop are distinct from gp41 binding, at least in terms of elements of gp41 not conserved across all strains. The fact that this is true not only for HIV-1 isolates, but also for divergent simian immunodeficiency virus (SIV)-HIV-1 and HIV-2-HIV-1 chimeras, provides additional evidence that 2F5 CDR H3 interactions are not specific for HIV-1 envelope. Because the hydrophobic tip of the CDR H3 represents only a small portion of the surface of antibody 2F5, it seems likely that the reduction in direct binding to lipid vesicles represents an averaging of the alteration in CDR H3 tip hydrophobicity relative to the entire 2F5 antibody. It thus seems reasonable to expect that the full effects of the mutations described herein for neutralization can likely be recapitulated in in vitro lipid binding assays only if the 2F5 CDR H3 loop is properly oriented relative to gp41 and the viral membrane, as it is in the virion/neutralization context, or when the gp41MPER is presented in a proteoliposome context. The difference between an oriented CDR H3 effect (large and significant) and an overall effect on direct biding to lipid vesicles (weak and less significant) may provide an explanation for the lack of 2F5 autoreactivity in in vivo studies; in the former case, the effect is amplified by the precise orientation of the CDR H3 to the viral membrane through binding to the protein component of the MPER epitope, while in the latter case, the effect is minimized by entropic effects and by averaging over the entire surface of the 2F5 antibody. Finally, it was noted that a number of proteins have interfacial binding properties similar to those proposed for 2F5. Soluble phospholipases A2, for instance, show dramatic interfacial activation of catalytic activity and require attachment to membranes to appropriately position a substrate for catalysis. Such systems may allow additional insight into the neutralization mechanism of 2F5. The sizes and hydrophobicities of likely membrane attachment surfaces, for example, are decreased in neurotoxic phospholipases A2, which need to avoid nonspecific membrane interactions during diffusion to the neuronal synapse. Indeed, quadratic fits of our neutralization versus CDR H3 hydrophobicity data resulted in improved correlations and appeared to reveal a threshold beyond which additional hydrophobicity did not enhance neutralization. Overall, these findings have numerous implications for optimization of 2F5 potency and for recreating 2F5-like antibodies in vaccine settings. Variants of 2F5 with tryptophan substitutions are already ~10-fold more potent than the wild type in terms of neutralization, and future designs of 2F5-based vaccine immunogens may thus need to account not only for structure-specific recognition of gp41 but also for the hydrophobic interactions mediated by the tip of the 2F5 CDR H3 loop.

Example 4

HIV-1 Monoclonal Neutralizing Antibodies Specific to gp120 or gp41 for Detecting HIV-1 in a Subject This example describes the use of HIV-1 monoclonal neutralizing antibodies specific to gp120 or gp41 for the detection of HIV-1 in a subject. This example further describes the use of these antibodies to confirm the diagnosis of HIV-1 in a subject.

A biological sample, such as a blood sample is obtained from the patient diagnosed with, or suspected of having an HIV-1 infection. A blood sample taken from a patient who is not infected is used as a control. An ELISA is performed to detect the presence of HIV-1 in the blood sample. Proteins present in the blood samples (the patient sample and control sample) are immobilized on a solid support, such as a 96-well plate, according to methods well known in the art (see, for example, Robinson et al., *Lancet* 362:1612-1616, 2003, incorporated herein by reference). Following immobilization, HIV-1 monoclonal neutralizing antibodies specific to gp120 or gp41 that is directly labeled with a fluorescent marker is applied to the protein-immobilized plate. The plate is washed in an appropriate buffer, such as PBS, to remove any unbound antibody and to minimize non-specific binding of antibody. Fluorescence can be detected using a fluorometric plate reader according to standard methods. An increase in fluorescence intensity of the patient sample, relative to the control sample, indicates the anti-gp120 or gp41 antibody specifically bound proteins from the blood sample, thus detecting the presence of HIV-1 protein in the sample. Detection of HIV-1 protein in the patient sample indicates the patient has HIV-1, or confirms diagnosis of HIV-1 in the subject.

Example 5

HIV-1 Monoclonal Neutralizing Antibodies Specific to gp120 or gp41 for the Treatment of HIV-1

This example describes a particular method that can be used to treat HIV in a human subject by administration of one or more gp120 or gp 41 specific human neutralizing mAbs. Although particular methods, dosages, and modes of administrations are provided, one skilled in the art will appreciate that variations can be made without substantially affecting the treatment.

Based upon the teaching disclosed herein HIV-1 can be treated by administering a therapeutically effective amount of one or more of the neutralizing mAbs described herein, thereby reducing or eliminating HIV infection.

Screening Subjects

In particular examples, the subject is first screened to determine if they have HIV. Examples of methods that can be used to screen for HIV include a combination of measuring a subject's CD4+ T cell count and the level of HIV in serum blood levels. Additional methods using the gp120- and gp41-specific mAbs described herein can also be used to screen for HIV.

In some examples, HIV testing consists of initial screening with an enzyme-linked immunosorbent assay (ELISA) to detect antibodies to HIV, such as to HIV-1. Specimens with a nonreactive result from the initial ELISA are considered HIV-negative unless new exposure to an infected partner or partner of unknown HIV status has occurred. Specimens with a reactive ELISA result are retested in duplicate. If the result of either duplicate test is reactive, the specimen is reported as repeatedly reactive and undergoes confirmatory testing with a more specific supplemental test (e.g., Western blot or an immunofluorescence assay (IFA)). Specimens that are repeatedly reactive by ELISA and positive by IFA or reactive by Western blot are considered HIV-positive and indicative of HIV infection. Specimens that are repeatedly ELISA-reactive occasionally provide an indeterminate Western blot result, which may be either an incomplete antibody response to HIV in an infected person, or nonspecific reactions in an uninfected person. IFA can be used to confirm infection in these ambiguous cases. In some instances, a second specimen will be collected more than a month later and retested for subjects with indeterminate Western blot results. In additional examples, nucleic acid testing (e.g., viral RNA or proviral DNA amplification method) can also help diagnosis in certain situations.

The detection of HIV in a subject's blood is indicative that the subject has HIV and is a candidate for receiving the therapeutic compositions disclosed herein. Moreover, detection of a CD4+ T cell count below 350 per microliter, such as 200 cells per microliter, is also indicative that the subject is likely to have HIV.

Pre-screening is not required prior to administration of the therapeutic compositions disclosed herein Pre-Treatment of Subjects In particular examples, the subject is treated prior to administration of a therapeutic agent that includes one or more antiretroviral therapies known to those of skill in the art. However, such pre-treatment is not always required, and can be determined by a skilled clinician.

Administration of Therapeutic Compositions

Following subject selection, a therapeutically effective dose of a gp120 or gp41 specific neutralizing mAb described herein is administered to the subject (such as an adult human or a newborn infant either at risk for contracting HIV or known to be infected with HIV). Additional agents, such as anti-viral agents, can also be administered to the subject simultaneously or prior to or following administration of the disclosed agents. Administration can be achieved by any method known in the art, such as oral administration, inhalation, intravenous, intramuscular, intraperitoneal, or subcutaneous.

The amount of the composition administered to prevent, reduce, inhibit, and/or treat HIV or a condition associated with it depends on the subject being treated, the severity of the disorder, and the manner of administration of the therapeutic composition. Ideally, a therapeutically effective amount of an agent is the amount sufficient to prevent, reduce, and/or inhibit, and/or treat the condition (e.g., HIV) in a subject without causing a substantial cytotoxic effect in the subject. An effective amount can be readily determined by one skilled in the art, for example using routine trials establishing dose response curves. As such, these compositions may be formulated with an inert diluent or with an pharmaceutically acceptable carrier.

In one specific example, antibodies are administered at 5 mg per kg every two weeks or 10 mg per kg every two weeks depending upon the particular stage of HIV. In an example, the antibodies are administered continuously. In another example, antibodies or antibody fragments are administered at 50 µg per kg given twice a week for 2 to 3 weeks.

Administration of the therapeutic compositions can be taken long term (for example over a period of months or years).

Assessment

Following the administration of one or more therapies, subjects having HIV can be monitored for reductions in HIV levels, increases in a subjects CD4+ T cell count, or reductions in one or more clinical symptoms associated with HIV. In particular examples, subjects are analyzed one or more times, starting 7 days following treatment. Subjects can be monitored using any method known in the art. For example, biological samples from the subject, including blood, can be obtained and alterations in HIV or CD4+ T cell levels evaluated.

Additional Treatments

In particular examples, if subjects are stable or have a minor, mixed or partial response to treatment, they can be re-treated after re-evaluation with the same schedule and preparation of agents that they previously received for the desired amount of time, including the duration of a subject's lifetime. A partial response is a reduction, such as at least a 10%, at least 20%, at least 30%, at least 40%, at least 50%, or at least 70% in HIV infection, HIV replication or combination thereof. A partial response may also be an increase in CD4+ T cell count such as at least 350 T cells per microliter.

Example 6

Use of Epitope Scaffolds as Immunological Probes

In order to detect and isolate structure specific antibodies against viral neutralizing determinants, use of heterologous epitope scaffolds can be used.

Epitope scaffolds are proteins that are surface engrafted with an epitope of choice in a manner that maintains the desired structural conformation of the epitope. In the case of gp41 epitope scaffolds, the gp41 membrane proximal extracellular region (MPER) target of the broadly neutralizing 2F5 antibody is engrafted onto the surface of heterologous proteins in a manner that preserves its 2F5-bound conformation. Five such scaffolds have been developed thus far using a graft that is derived from a clade B virus. Epitope scaffolds with MPER grafts derived from other clades, such as clades C and A and any other clades or gp41 sequences that should be required, are also included as immunological probes in this disclosure. Point mutations within the grafts which knock out binding to 2F5 are also included for use as negative selection agents—in that isolated antibodies directed against the core of the MPER epitope should not be able to bind to these point mutants.

When used as probes, the gp41MPER epitope scaffolds are biotinylated as previously described (Doria-Rose, et al, Journal of Virology, January 2009, p. 188-199, Vol. 83, No. 1). An Avitag sequence for biotinylation (LNDIFEAQKIEWHE, SEQ ID NO: 26) is added at the c-terminal end of the scaffold (see sequences below). After expression in either mammalian cells (e.g., 293 freestyle cells, Invitrogen) or in *E. coli* cells (e.g., BL21 cells, Novagen), Biotin ligase Bir A (Avidity, Denver, Colo.) is used to biotinylate the scaffolds at the Avitag sequence.

Sequences of gp41MPER Epitope Scaffold Immunological Probes (graft are underlined and in bold):

ES1 (1LGYA)
ES1 (1LGYA) Clade B (SEQ ID NO: 11):
EVLEADKWAILGATKYAGIAATAYCRSVVPGNKWDCVQCQKWVPDGKIITTFTSLLSDTNGYVLRS

DKQKTIYLVFRGTNSFRSAITDIVFNFSDYKPVKGAKVHAGFLSSYEQVVNDYFPVVQEQLTAHPTY

KVIVTGHSLGGAQALLAGMDLYQREPRLSPANLSIFTVGGPRVGNPTFAYYVESTGIPFARTVHKRDI

VPHVPPQSFGFLHPGVESWIKSGTSNVQVCGSAIETKDCSNSIVPFTSILDHLSYFDINEGSCLSGLVPR

GSGSHHHHHHGGLNDIFEAQKIEWHE

ES1 (1LGYA) Clade B point mutant (SEQ ID NO: 12):
EVLEADEWAILGATKYAGIAATAYCRSVVPGNKWDCVQCQKWVPDGKIITTFTSLLSDTNGYVLRS

DKQKTIYLVFRGTNSFRSAITDIVFNFSDYKPVKGAKVHAGFLSSYEQVVNDYFPVVQEQLTAHPTY

KVIVTGHSLGGAQALLAGMDLYQREPRLSPANLSIFTVGGPRVGNPTFAYYVESTGIPFARTVHKRDI

VPHVPPQSFGFLHPGVESWIKSGTSNVQVCGSAIETKDCSNSIVPFTSILDHLSYFDINEGSCLSGLVPR

GSGSHHHHHHGGLNDIFEAQKIEWHE

ES1 (1LGYA) Clade C (SEQ ID NO: 13):
EVLALDSWKNLGATKYAGIAATAYCRSVVPGNKWDCVQCQKWVPDGKIITTFTSLLSDTNGYVLR

SDKQKTIYLVFRGTNSFRSAITDIVFNFSDYKPVKGAKVHAGFLSSYEQVVNDYFPVVQEQLTAHPTY

KVIVTGHSLGGAQALLAGMDLYQREPRLSPANLSIFTVGGPRVGNPTFAYYVESTGIPFARTVHKRDI

VPHVPPQSFGFLHPGVESWIKSGTSNVQVCGSAIETKDCSNSIVPFTSILDHLSYFDINEGSCLSGLVPR

GSGSHHHHHHGGLNDIFEAQKIEWHE

ES2 (1KU2A-s)
ES2 (1KU2A-s) Clade B (SEQ ID NO: 14):
ASDPVRQYLHEIGEVLELDKWAELGAAAKVEEGMEAIKKLSEATGLDQELIREVVRAKILGTAAIQ

KIPGLKEKPDPKTVEEVDGKLKSLPKELKRYLHIAREGEAARQHLIEANLRLVVSIAKKYTGRGLSFL

DLIQEGNQGLIRAVEKFEYKRGFAFSTYATWWIRQAINRAIADQARSGLVPRGSGSHHHHHHGGLND

IFEAQKIEWHE

ES2 (1KU2A-s) Clade B point mutant (SEQ ID NO: 15):
ASDPVRQYLHEIGEVLELDEWAELGAAAKVEEGMEAIKKLSEATGLDQELIREVVRAKILGTAAIQK

IPGLKEKPDPKTVEEVDGKLKSLPKELKRYLHIAREGEAARQHLIEANLRLVVSIAKKYTGRGLSFLD

LIQEGNQGLIRAVEKFEYKRGFAFSTYATWWIRQAINRAIADQARSGLVPRGSGSHHHHHHGGLNDI

FEAQKIEWHE

ES2 (1KU2A-s) Clade C (SEQ ID NO: 16):
ASDPVRQYLHEIGEVLALDSWKNLGAAAKVEEGMEAIKKLSEATGLDQELIREVVRAKILGTAAIQ

KIPGLKEKPDPKTVEEVDGKLKSLPKELKRYLHIAREGEAARQHLIEANLRLVVSIAKKYTGRGLSFL

DLIQEGNQGLIRAVEKFEYKRGFAFSTYATWWIRQAINRAIADQARSGLVPRGSGSHHHHHHGGLND

IFEAQKIEWHE

ES3 (2MATA)
ES3 (2MATA) Clade B (SEQ ID NO: 17):
EILELDKWAILGMRVAGRLAAEVLEMIEPYVKPGVSTGELDRICNDYIVNEQHAVSACLGYHGYPK

SVCISINEVVCHGIPDDAKLLKDGDIVNIDVTVIKAGAHGDTSKMFIVGKPTIMGERLCRITQESLYLA

LRMVKPGINLREIGAAIQKFVEAEGFSVVREYCGHGIGGGFHEEPQVLHYDSRETNVVLKPGMTFTIE

PMVNAGKKEIRTMKDGWTVKTKDRSLSAQYEHTIVVTDNGCEILTLRKDDTIPAIISHDSGLVPRGSG

SHHHHHHGGLNDIFEAQKIEWHE

ES3 (2MATA) Clade B point mutant (SEQ ID NO: 18):
EILELDEWAILGMRVAGRLAAEVLEMIEPYVKPGVSTGELDRICNDYIVNEQHAVSACLGYHGYPK

SVCISINEVVCHGIPDDAKLLKDGDIVNIDVTVIKAGAHGDTSKMFIVGKPTIMGERLCRITQESLYLA

LRMVKPGINLREIGAAIQKFVEAEGFSVVREYCGHGIGGGFHEEPQVLHYDSRETNVVLKPGMTFTIE

PMVNAGKKEIRTMKDGWTVKTKDRSLSAQYEHTIVVTDNGCEILTLRKDDTIPAIISHDSGLVPRGSG

SHHHHHHGGLNDIFEAQKIEWHE

ES3 (2MATA) Clade C (SEQ ID NO: 19):
EILALDSWKNLGMRVAGRLAAEVLEMIEPYVKPGVSTGELDRICNDYIVNEQHAVSACLGYHGYPK

SVCISINEVVCHGIPDDAKLLKDGDIVNIDVTVIKAGAHGDTSKMFIVGKPTIMGERLCRITQESLYLA

LRMVKPGINLREIGAAIQKFVEAEGFSVVREYCGHGIGGGFHEEPQVLHYDSRETNVVLKPGMTFTIE

PMVNAGKKEIRTMKDGWTVKTKDRSLSAQYEHTIVVTDNGCEILTLRKDDTIPAIISHDSGLVPRGSG

SHHHHHHGGLNDIFEAQKIEWHE

ES4 (1IWLA)
ES4 (1IWLA) Clade B (SEQ ID NO: 20):
DAASDLKSRLDKVSSFGAGFTQKVTDVQEGQGALAVKRPNLFAWHMTQPDESILVSDGKTLWFYNP

FVEQATATWLKDATGNTPFMLIARNQSSDWQQYNIKQNGDDFVLTPKASNGNLKQFTINVGRDGTI

HQFSAVEQDDQRSSYQLKAQENLEVDKWAFLFGPPQGVTVDDQRKSGLVPRGSGSHHHHHHGGL

NDIFEAQKIEWHE

ES4 (1IWLA) Clade B point mutant (SEQ ID NO: 21):
DAASDLKSRLDKVSSFGAGFTQKVTDVQEGQGALAVKRPNLFAWHMTQPDESILVSDGKTLWFYNP

FVEQATATWLKDATGNTPFMLIARNQSSDWQQYNIKQNGDDFVLTPKASNGNLKQFTINVGRDGTI

HQFSAVEQDDQRSSYQLKAQENLEVDEWAFLFGPPQGVTVDDQRKSGLVPRGSGSHHHHHHGGLN

DIFEAQKIEWHE

ES4 (1IWLA) Clade C (SEQ ID NO: 22):
DAASDLKSRLDKVSSFGAGFTQKVTDVQEGQGALAVKRPNLFAWHMTQPDESILVSDGKTLWFYNP

FVEQATATWLKDATGNTPFMLIARNQSSDWQQYNIKQNGDDFVLTPKASNGNLKQFTINVGRDGTI

HQFSAVEQDDQRSSYQLKAQENLAVDSWKNLFGPPQGVTVDDQRKSGLVPRGSGSHHHHHHGGL

NDIFEAQKIEWHE

ES5 (1D3BB)
ES5 (1D3BB) Clade B (SEQ ID NO: 23):
SKMLQHIDYRMRCIGGAGGIAIGTFKAFGAGMGLILCDCDAFAKIKPKNSKQAEREEKAVGELLELD

KWALLSMTVEGPPPSGLVPRGSGSHHHHHHGGLNDIFEAQKIEWHE

ES5 (1D3BB) Clade B point mutant (SEQ ID NO: 24):
SKMLQHIDYRMRCIGGAGGIAIGTFKAFGAGMGLILCDCDAFAKIKPKNSKQAEREEKAVGELLELD

EWALLSMTVEGPPPSGLVPRGSGSHHHHHHGGLNDIFLAQKIEWHE

ES5 (1D3BB) Clade C (SEQ ID NO: 25):
SKMLQHIDYRMRCIGGAGGIAIGTFKAFGAGMGLILCDCDAFAKIKPKNSKQAEREEKAVGELLALD

SWKNLSMTVEGPPPSGLVPRGSGSHHHHHHGGLNDIFEAQKIEWHE

Example 7

Identification of VCR1-Like Antibodies

To demonstrate that light heavy chain complementation can be used to identify a VR01, VCR03-like antibody, VRC01/VRC03 chimera were created and expressed (see FIG. 76). The chimeric antibodies were tested for neutralization of HIV constructs (see FIGS. 77-79). The results of the chimeric neutralization studies demonstrated that complementation predicts an antibody as VRC01 and VRC03-like antibodies. Thus complementation is applied to antibody heavy chain sequences generated by 454 sequencing.

454 sequencing was carried out on a sample obtained from subject 45, and 200,000 heavy chain sequences were sorted through these based on threading and retention of specific residues associated with VRC01 and VRC03 to identify VRC01 and VRC03 like antibody sequence. 700 sequences, with a variable sequence identity to VRC01 and VRC03 were obtained. To evaluate whether or not these antibodies can adopt the VRC03 binding mode, their sequences have been "threaded" onto the crystal structure of VRC03/gp120 complex and a so-called threading score was calculated for each of the sequences.

The use of threading technique allow incorporation the structural information into the 454 sequencing analysis and to select the sequences that can potentially adopt the desired binding mode, which has been precisely characterized by the three structures of antibody/gp120 complexes (see Wu et al. Rational Design of Envelope Identifies Broadly Neutralizing Human Monoclonal Antibodies to HIV-1, "Science 329, 856-861 (2010), which is incorporated herein by reference in its entirety and Zhou et al., "Structural Basis for Broad and Potent Neutralization of HIV-1 by Antibody VRC01, Science 329, 811-817 (2010), which is incorporated herein by reference in its entirety). The threading scores range from 0.07 to 0.13, which are in the lower range of the values calculated from the threading of VRC01 and VRC03 and onto each other (The lower the threading score is, the better the sequence matches the structure). This result indicates that these antibodies are be VRC01-like.

A sequence alignment of one of these antibody heavy chains (Antibody Heavy Chain No: 57203) is shown in FIG. 80 compared to the amino acid sequences of the heavy chains of VRC01, VRC02, and VRC03 and the germline sequence IGHV1-02*02.1N Antibody Heavy Chain No: 57203 was synthesize and a chimera between this heavy chain and the light chain of VRC01 was created. These antibodies were tested for neutralization, when combined with VRC01 light chain (see FIG. 81A-81H). Thus, as disclosed herein, a class of VRC01-like antibodies (heavy chain variable domain only) has been identified.

Below is a list of the heavy chains of VRC01 and VRC03-like antibodies identified. Shown are assigned number of the heavy chain, the deduced germline (germ), the percent identity to VRC01 (seqid1), the percent identity to VRC03 (seqid3), the threading value (thrd1), the divergence from the genrmline sequence (divg), the nucleic acid sequence identifier and the amino acid sequence identifier.

VRC01 and VRC03-Like Antibodies

Antibody Heavy Chain No: 81364 germ=IGHV1-2*02 seqid1=54.5 seqid3=92.3 thrd1=0.259 thrd3=0.092 divg=0.304 Nucleic acid sequence=SEQ ID NO: 60 Amino acid sequence=SEQ ID NO: 760; Antibody Heavy Chain No: 140214 germ=IGHV1-2*02 seqid1=58.7 seqid3=99.2 thrd1=0.305 thrd3=0.031 divg=0.297 Nucleic acid sequence=SEQ ID NO: 61 Amino acid sequence=SEQ ID NO: 761; Antibody Heavy Chain No: 64244 germ=IGHV1-2*02 seqid1=59.5 seqid3=99.2 thrd1=0.350 thrd3=0.111 divg=0.297 Nucleic acid sequence=SEQ ID NO: 62 Amino acid sequence=SEQ ID NO: 762; Antibody Heavy Chain No: 30181 germ=IGHV1-2*02 seqid1=54.5 seqid3=88.5 thrd1=0.311 thrd3=0.081 divg=0.297 Nucleic acid sequence=SEQ ID NO: 63 Amino acid sequence=SEQ ID NO: 763; Antibody Heavy Chain No: 22829 germ=IGHV1-2*02 seqid1=59.5 seqid3=100.0 thrd1=0.310 thrd3=0.031 divg=0.294 Nucleic acid sequence=SEQ ID NO: 64 Amino acid sequence=SEQ ID NO: 764; Antibody Heavy Chain No: 34065 germ=IGHV1-2*02 seqid1=59.5 seqid3=100.0 thrd1=0.310 thrd3=0.031 divg=0.294 Nucleic acid sequence=SEQ ID NO: 65 Amino acid sequence=SEQ ID NO: 765; Antibody Heavy Chain No: 42537 germ=IGHV1-2*02 seqid1=59.5 seqid3=100.0 thrd1=0.310 thrd3=0.031 divg=0.294 Nucleic acid sequence=SEQ ID NO: 66 Amino acid sequence=SEQ ID NO: 766; Antibody Heavy Chain No: 37825 germ=IGHV1-2*02 seqid1=51.2 seqid3=50.8 thrd1=0.167 thrd3=0.140 divg=0.209 Nucleic acid sequence=SEQ ID NO: 67 Amino acid sequence=SEQ ID NO: 767; Antibody Heavy Chain No: 12853 germ=IGHV1-2*02 seqid1=47.1 seqid3=42.3 thrd1=0.206 thrd3=0.230 divg=0.209 Nucleic acid sequence=SEQ ID NO: 68 Amino acid sequence=SEQ ID NO: 768; Antibody Heavy Chain No: 100463 germ=IGHV1-2*02 seqid1=49.6 seqid3=49.2 thrd1=0.173 thrd3=0.126 divg=0.209 Nucleic acid sequence=SEQ ID NO: 69 Amino acid sequence=SEQ ID NO: 769; Antibody Heavy Chain No: 127918 germ=IGHV1-2*02 seqid1=43.0 seqid3=43.1 thrd1=0.211 thrd3=0.142 divg=0.209 Nucleic acid sequence=SEQ ID NO: 70 Amino acid sequence=SEQ ID NO: 770; Antibody Heavy Chain No: 25055 germ=IGHV1-2*02 seqid1=57.9 seqid3=51.5 thrd1=0.203 thrd3=0.211 divg=0.206 Nucleic acid sequence=SEQ ID NO: 71 Amino acid sequence=SEQ ID NO: 771; Antibody Heavy Chain No: 92641 germ=IGHV1-2*02 seqid1=48.8 seqid3=45.4 thrd1=0.199 thrd3=0.242 divg=0.199 Nucleic acid sequence=SEQ ID NO: 72 Amino acid sequence=SEQ ID NO: 772; Antibody Heavy Chain No: 24567 germ=IGHV1-2*02 seqid1=48.8 seqid3=43.1 thrd1=0.142 thrd3=0.124 divg=0.196 Nucleic acid sequence=SEQ ID NO: 73 Amino acid sequence=SEQ ID NO: 773; Antibody Heavy Chain No: 60412 germ=IGHV1-2*02 seqid1=47.9 seqid3=41.5 thrd1=0.164 thrd3=0.156 divg=0.196 Nucleic acid sequence=SEQ ID NO: 74 Amino acid sequence=SEQ ID NO: 774; Antibody Heavy Chain No: 41501 germ=IGHV1-2*02 seqid1=48.8 seqid3=43.1 thrd1=0.142 thrd3=0.124 divg=0.193 Nucleic acid sequence=SEQ ID NO: 75 Amino acid sequence=SEQ ID NO: 775; Antibody Heavy Chain No: 25764 germ=IGHV1-2*02 seqid1=49.6 seqid3=42.3 thrd1=0.192 thrd3=0.136 divg=0.193 Nucleic acid sequence=SEQ ID NO: 76 Amino acid sequence=SEQ ID NO: 776; Antibody Heavy Chain No: 25287 germ=IGHV1-2*02 seqid1=47.1 seqid3=44.6 thrd1=0.143 thrd3=0.229 divg=0.189 Nucleic acid sequence=SEQ ID NO: 77 Amino acid sequence=SEQ ID NO: 777; Antibody Heavy Chain No: 25949 germ=IGHV1-2*02 seqid1=48.8 seqid3=44.6 thrd1=0.191 thrd3=0.145 divg=0.186 Nucleic acid sequence=SEQ ID NO: 78 Amino acid sequence=SEQ ID NO: 778; Antibody Heavy Chain No: 26177 germ=IGHV1-2*02 seqid1=47.1 seqid3=43.8 thrd1=0.209 thrd3=0.169 divg=0.186 Nucleic acid sequence=SEQ ID NO: 79 Amino acid sequence=SEQ ID NO: 779; Antibody Heavy Chain No: 32644 germ=IGHV1-2*02 seqid1=47.9 seqid3=45.4 thrd1=0.161 thrd3=0.166 divg=0.182 Nucleic acid sequence=SEQ ID NO: 80 Amino acid sequence=SEQ ID NO: 780; Antibody Heavy Chain No: 62663 germ=IGHV1-2*02 seqid1=47.9 seqid3=45.4 thrd1=0.161 thrd3=0.166 divg=0.182 Nucleic acid sequence=SEQ ID NO: 81 Amino acid sequence=SEQ ID NO: 781; Antibody Heavy Chain No: 19531 germ=IGHV1-2*02 seqid1=53.7 seqid3=49.2 thrd1=0.147 thrd3=0.094 divg=0.182 Nucleic acid sequence=SEQ ID NO: 82 Amino acid sequence=SEQ ID NO: 782; Antibody Heavy Chain No: 18715 germ=IGHV1-2*02 seqid1=46.3 seqid3=41.5 thrd1=0.257 thrd3=0.267 divg=0.182 Nucleic acid sequence=SEQ ID NO: 83 Amino acid sequence=SEQ ID NO: 783; Antibody Heavy Chain No: 13817 germ=IGHV1-2*02 seqid1=53.7 seqid3=49.2 thrd1=0.147 thrd3=0.094 divg=0.179 Nucleic acid sequence=SEQ ID NO: 84 Amino acid sequence=SEQ ID NO: 784; Antibody Heavy Chain No: 53390 germ=IGHV1-2*02 seqid1=45.5 seqid3=43.8 thrd1=0.177 thrd3=0.148 divg=0.179 Nucleic acid sequence=SEQ ID NO: 85 Amino acid sequence=SEQ ID NO: 785; Antibody Heavy Chain No: 6665 germ=IGHV1-2*02 seqid1=46.3 seqid3=44.6 thrd1=0.178 thrd3=0.150 divg=0.179 Nucleic acid sequence=SEQ ID NO: 86 Amino acid sequence=SEQ ID NO: 786; Antibody Heavy Chain No:

19618 germ=IGHV1-2*02 seqid1=49.6 seqid3=46.2 thrd1=0.192 thrd3=0.147 divg=0.179 Nucleic acid sequence=SEQ ID NO: 87 Amino acid sequence=SEQ ID NO: 787; Antibody Heavy Chain No: 55471 germ=IGHV1-2*02 seqid1=47.9 seqid3=43.8 thrd1=0.204 thrd3=0.208 divg=0.179 Nucleic acid sequence=SEQ ID NO: 88 Amino acid sequence=SEQ ID NO: 788; Antibody Heavy Chain No: 57053 germ=IGHV1-2*02 seqid1=49.6 seqid3=46.2 thrd1=0.180 thrd3=0.152 divg=0.176 Nucleic acid sequence=SEQ ID NO: 89 Amino acid sequence=SEQ ID NO: 789; Antibody Heavy Chain No: 43247 germ=IGHV1-2*02 seqid1=52.9 seqid3=48.5 thrd1=0.170 thrd3=0.141 divg=0.176 Nucleic acid sequence=SEQ ID NO: 90 Amino acid sequence=SEQ ID NO: 790; Antibody Heavy Chain No: 79236 germ=IGHV1-2*02 seqid1=52.9 seqid3=48.5 thrd1=0.173 thrd3=0.145 divg=0.176 Nucleic acid sequence=SEQ ID NO: 91 Amino acid sequence=SEQ ID NO: 791; Antibody Heavy Chain No: 72343 germ=IGHV1-2*02 seqid1=52.9 seqid3=48.5 thrd1=0.168 thrd3=0.141 divg=0.176 Nucleic acid sequence=SEQ ID NO: 92 Amino acid sequence=SEQ ID NO: 792; Antibody Heavy Chain No: 100843 germ=IGHV1-2*02 seqid1=49.6 seqid3=45.4 thrd1=0.244 thrd3=0.254 divg=0.176 Nucleic acid sequence=SEQ ID NO: 93 Amino acid sequence=SEQ ID NO: 793; Antibody Heavy Chain No: 26236 germ=IGHV1-2*02 seqid1=49.6 seqid3=46.2 thrd1=0.193 thrd3=0.174 divg=0.176 Nucleic acid sequence=SEQ ID NO: 94 Amino acid sequence=SEQ ID NO: 794; Antibody Heavy Chain No: 77123 germ=IGHV1-2*02 seqid1=49.6 seqid3=46.2 thrd1=0.190 thrd3=0.176 divg=0.176 Nucleic acid sequence=SEQ ID NO: 95 Amino acid sequence=SEQ ID NO: 795; Antibody Heavy Chain No: 59418 germ=IGHV1-2*02 seqid1=49.6 seqid3=46.2 thrd1=0.190 thrd3=0.176 divg=0.176 Nucleic acid sequence=SEQ ID NO: 96 Amino acid sequence=SEQ ID NO: 796; Antibody Heavy Chain No: 10050 germ=IGHV1-2*02 seqid1=53.7 seqid3=49.2 thrd1=0.170 thrd3=0.142 divg=0.172 Nucleic acid sequence=SEQ ID NO: 97 Amino acid sequence=SEQ ID NO: 797; Antibody Heavy Chain No: 68011 germ=IGHV1-2*02 seqid1=49.6 seqid3=46.2 thrd1=0.191 thrd3=0.172 divg=0.172 Nucleic acid sequence=SEQ ID NO: 98 Amino acid sequence=SEQ ID NO: 798; Antibody Heavy Chain No: 72256 germ=IGHV1-2*02 seqid1=39.7 seqid3=36.2 thrd1=0.275 thrd3=0.254 divg=0.172 Nucleic acid sequence=SEQ ID NO: 99 Amino acid sequence=SEQ ID NO: 799; Antibody Heavy Chain No: 42369 germ=IGHV1-2*02 seqid1=39.7 seqid3=38.5 thrd1=0.276 thrd3=0.269 divg=0.172 Nucleic acid sequence=SEQ ID NO: 100 Amino acid sequence=SEQ ID NO: 800; Antibody Heavy Chain No: 82140 germ=IGHV1-2*02 seqid1=53.7 seqid3=49.2 thrd1=0.147 thrd3=0.094 divg=0.172 Nucleic acid sequence=SEQ ID NO: 101 Amino acid sequence=SEQ ID NO: 801; Antibody Heavy Chain No: 6646 germ=IGHV1-2*02 seqid1=53.7 seqid3=49.2 thrd1=0.147 thrd3=0.094 divg=0.172 Nucleic acid sequence=SEQ ID NO: 102 Amino acid sequence=SEQ ID NO: 802; Antibody Heavy Chain No: 62367 germ=IGHV1-2*02 seqid1=49.6 seqid3=46.2 thrd1=0.191 thrd3=0.172 divg=0.172 Nucleic acid sequence=SEQ ID NO: 103 Amino acid sequence=SEQ ID NO: 803; Antibody Heavy Chain No: 84652 germ=IGHV1-2*02 seqid1=51.2 seqid3=47.7 thrd1=0.217 thrd3=0.229 divg=0.172 Nucleic acid sequence=SEQ ID NO: 104 Amino acid sequence=SEQ ID NO: 804; Antibody Heavy Chain No: 109302 germ=IGHV1-2*02 seqid1=43.8 seqid3=41.5 thrd1=0.257 thrd3=0.241 divg=0.172 Nucleic acid sequence=SEQ ID NO: 105 Amino acid sequence=SEQ ID NO: 805; Antibody Heavy Chain No: 56047 germ=IGHV1-2*02 seqid1=49.6 seqid3=46.2 thrd1=0.190 thrd3=0.176 divg=0.172 Nucleic acid sequence=SEQ ID NO: 106 Amino acid sequence=SEQ ID NO: 806; Antibody Heavy Chain No: 8045 germ=IGHV1-2*02 seqid1=52.9 seqid3=48.5 thrd1=0.155 thrd3=0.100 divg=0.172 Nucleic acid sequence=SEQ ID NO: 107 Amino acid sequence=SEQ ID NO: 807; Antibody Heavy Chain No: 103312 germ=IGHV1-2*02 seqid1=49.6 seqid3=46.2 thrd1=0.191 thrd3=0.172 divg=0.172 Nucleic acid sequence=SEQ ID NO: 108 Amino acid sequence=SEQ ID NO: 808; Antibody Heavy Chain No: 16454 germ=IGHV1-2*02 seqid1=53.7 seqid3=49.2 thrd1=0.170 thrd3=0.142 divg=0.172 Nucleic acid sequence=SEQ ID NO: 109 Amino acid sequence=SEQ ID NO: 809; Antibody Heavy Chain No: 106554 germ=IGHV1-2*02 seqid1=49.6 seqid3=46.2 thrd1=0.147 thrd3=0.095 divg=0.172 Nucleic acid sequence=SEQ ID NO: 110 Amino acid sequence=SEQ ID NO: 810; Antibody Heavy Chain No: 30765 germ=IGHV1-2*02 seqid1=53.7 seqid3=49.2 thrd1=0.147 thrd3=0.094 divg=0.172 Nucleic acid sequence=SEQ ID NO: 111 Amino acid sequence=SEQ ID NO: 811; Antibody Heavy Chain No: 120328 germ=IGHV1-2*02 seqid1=49.6 seqid3=46.2 thrd1=0.169 thrd3=0.099 divg=0.172 Nucleic acid sequence=SEQ ID NO: 112 Amino acid sequence=SEQ ID NO: 812; Antibody Heavy Chain No: 71818 germ=IGHV1-2*02 seqid1=51.2 seqid3=46.9 thrd1=0.170 thrd3=0.142 divg=0.172 Nucleic acid sequence=SEQ ID NO: 113 Amino acid sequence=SEQ ID NO: 813; Antibody Heavy Chain No: 75349 germ=IGHV1-2*02 seqid1=49.6 seqid3=46.2 thrd1=0.173 thrd3=0.147 divg=0.172 Nucleic acid sequence=SEQ ID NO: 114 Amino acid sequence=SEQ ID NO: 814; Antibody Heavy Chain No: 84800 germ=IGHV1-2*02 seqid1=53.7 seqid3=49.2 thrd1=0.147 thrd3=0.094 divg=0.172 Nucleic acid sequence=SEQ ID NO: 115 Amino acid sequence=SEQ ID NO: 815; Antibody Heavy Chain No: 30534 germ=IGHV1-2*02 seqid1=52.1 seqid3=47.7 thrd1=0.277 thrd3=0.171 divg=0.172 Nucleic acid sequence=SEQ ID NO: 116 Amino acid sequence=SEQ ID NO: 816; Antibody Heavy Chain No: 116747 germ=IGHV1-2*02 seqid1=49.6 seqid3=46.2 thrd1=0.190 thrd3=0.176 divg=0.172 Nucleic acid sequence=SEQ ID NO: 117 Amino acid sequence=SEQ ID NO: 817; Antibody Heavy Chain No: 59966 germ=IGHV1-2*02 seqid1=39.7 seqid3=34.6 thrd1=0.310 thrd3=0.192 divg=0.172 Nucleic acid sequence=SEQ ID NO: 118 Amino acid sequence=SEQ ID NO: 818; Antibody Heavy Chain No: 55155 germ=IGHV1-2*02 seqid1=49.6 seqid3=46.2 thrd1=0.191 thrd3=0.172 divg=0.172 Nucleic acid sequence=SEQ ID NO: 119 Amino acid sequence=SEQ ID NO: 819; Antibody Heavy Chain No: 44011 germ=IGHV1-2*02 seqid1=52.9 seqid3=48.5 thrd1=0.170 thrd3=0.142 divg=0.172 Nucleic acid sequence=SEQ ID NO: 120 Amino acid sequence=SEQ ID NO: 820; Antibody Heavy Chain No: 52929 germ=IGHV1-2*02 seqid1=48.8 seqid3=45.4 thrd1=0.194 thrd3=0.163 divg=0.172 Nucleic acid sequence=SEQ ID NO: 121 Amino acid sequence=SEQ ID NO: 821; Antibody Heavy Chain No: 23585 germ=IGHV1-2*02 seqid1=53.7 seqid3=49.2 thrd1=0.170 thrd3=0.142 divg=0.169 Nucleic acid sequence=SEQ ID NO: 122 Amino acid sequence=SEQ ID NO: 822; Antibody Heavy Chain No: 18356 germ=IGHV1-2*02 seqid1=49.6 seqid3=46.2 thrd1=0.177 thrd3=0.149 divg=0.169 Nucleic acid sequence=SEQ ID NO: 123 Amino acid sequence=SEQ ID NO: 823; Antibody Heavy Chain No: 47548 germ=IGHV1-2*02 seqid1=49.6 seqid3=46.2 thrd1=0.190 thrd3=0.176 divg=0.169 Nucleic acid sequence=SEQ ID NO: 124 Amino acid sequence=SEQ ID NO: 824; Antibody Heavy Chain No: 16445 germ=IGHV1-2*02 seqid1=48.8 seqid3=46.2 thrd1=0.178 thrd3=0.152 divg=0.169 Nucleic acid sequence=SEQ ID NO: 125 Amino acid sequence=SEQ ID NO: 825; Antibody Heavy Chain No: 54787 germ=IGHV1-2*02 seqid1=49.6 seqid3=46.2 thrd1=0.173 thrd3=0.147 divg=0.169 Nucleic acid sequence=SEQ ID NO: 126 Amino acid sequence=SEQ ID NO: 826; Antibody Heavy Chain No: 54832 germ=IGHV1-2*02 seqid1=40.5 seqid3=38.5 thrd1=0.217 thrd3=0.222 divg=0.169 Nucleic acid sequence=SEQ ID NO: 127 Amino acid sequence=SEQ ID NO: 827; Antibody Heavy Chain No: 113458 germ=IGHV1-2*02 seqid1=53.7 seqid3=49.2 thrd1=0.147 thrd3=0.094 divg=0.169 Nucleic acid sequence=SEQ ID NO: 128 Amino acid sequence=SEQ ID NO: 828; Antibody Heavy Chain No: 73745 germ=IGHV1-2*02 seqid1=53.7 seqid3=49.2 thrd1=0.147 thrd3=0.094 divg=0.169 Nucleic acid sequence=SEQ ID NO: 129 Amino acid sequence=SEQ ID NO: 829; Antibody Heavy Chain No: 63091 germ=IGHV1-2*02 seqid1=33.9 seqid3=30.8 thrd1=0.239 thrd3=0.246 divg=0.169 Nucleic acid sequence=SEQ ID NO: 130 Amino acid sequence=SEQ ID NO: 830; Antibody Heavy Chain No: 55725 germ=IGHV1-2*02 seqid1=49.6 seqid3=46.2 thrd1=0.191 thrd3=0.172 divg=0.169 Nucleic acid sequence=SEQ ID NO: 131 Amino acid sequence=SEQ ID NO: 831; Antibody Heavy Chain No: 107427 germ=IGHV1-2*02 seqid1=49.6 seqid3=46.2 thrd1=0.190 thrd3=0.176 divg=0.169 Nucleic acid sequence=SEQ ID NO: 132 Amino acid sequence=SEQ ID NO: 832; Antibody Heavy Chain No: 112250 germ=IGHV1-2*02 seqid1=53.7 seqid3=49.2 thrd1=0.170 thrd3=0.142 divg=0.169 Nucleic acid sequence=SEQ ID NO: 133 Amino acid sequence=SEQ ID NO: 833; Antibody Heavy Chain No: 86179 germ=IGHV1-2*02 seqid1=49.6 seqid3=46.2 thrd1=0.190 thrd3=0.176 divg=0.169 Nucleic acid sequence=SEQ ID NO: 134 Amino acid sequence=SEQ ID NO: 834; Antibody Heavy Chain No: 111621 germ=IGHV1-2*02 seqid1=49.6 seqid3=46.2 thrd1=0.172 thrd3=0.149 divg=0.169 Nucleic acid sequence=SEQ ID NO: 135 Amino acid sequence=SEQ ID NO: 835; Antibody Heavy Chain No: 18139 germ=IGHV1-2*02 seqid1=53.7 seqid3=49.2 thrd1=0.170 thrd3=0.142 divg=0.169 Nucleic acid sequence=SEQ ID NO: 136 Amino acid sequence=SEQ ID NO: 836; Antibody Heavy Chain No: 56200 germ=IGHV1-2*02 seqid1=52.9 seqid3=50.8 thrd1=0.150 thrd3=0.104 divg=0.166 Nucleic acid sequence=SEQ ID NO: 137 Amino acid sequence=SEQ ID NO: 837; Antibody Heavy Chain No: 75470 germ=IGHV1-2*02 seqid1=52.9 seqid3=50.8 thrd1=0.150 thrd3=0.104 divg=0.166 Nucleic acid sequence=SEQ ID NO: 138 Amino acid sequence=SEQ ID NO: 838; Antibody Heavy Chain No: 48168 germ=IGHV1-2*02 seqid1=47.9 seqid3=44.6 thrd1=0.155 thrd3=0.191 divg=0.166 Nucleic acid sequence=SEQ ID NO: 139 Amino acid sequence=SEQ ID NO: 839; Antibody Heavy Chain No: 78596 germ=IGHV1-2*02 seqid1=51.2 seqid3=50.0 thrd1=0.194 thrd3=0.122 divg=0.166 Nucleic acid sequence=SEQ ID NO: 140 Amino acid sequence=SEQ ID NO: 840; Antibody Heavy Chain No: 69129 germ=IGHV1-2*02 seqid1=52.9 seqid3=50.8 thrd1=0.150 thrd3=0.104 divg=0.166 Nucleic acid sequence=SEQ ID NO: 141 Amino acid sequence=SEQ ID NO: 841; Antibody Heavy Chain No: 107212 germ=IGHV1-2*02 seqid1=47.9 seqid3=44.6 thrd1=0.151 thrd3=0.189 divg=0.162 Nucleic acid sequence=SEQ ID NO: 142 Amino acid sequence=SEQ ID NO: 842; Antibody Heavy Chain No: 71549 germ=IGHV1-2*02 seqid1=47.9 seqid3=44.6 thrd1=0.151 thrd3=0.189 divg=0.162 Nucleic acid sequence=SEQ ID NO: 143 Amino acid sequence=SEQ ID NO: 843; Antibody Heavy Chain No: 19124 germ=IGHV1-2*02 seqid1=45.5 seqid3=42.3 thrd1=0.153 thrd3=0.196 divg=0.162 Nucleic acid sequence=SEQ ID NO: 144 Amino acid sequence=SEQ ID NO: 844; Antibody Heavy Chain No: 100576 germ=IGHV1-2*02 seqid1=52.9 seqid3=50.8 thrd1=0.190 thrd3=0.118 divg=0.162 Nucleic acid sequence=SEQ ID NO: 145 Amino acid sequence=SEQ ID NO: 845; Antibody Heavy Chain No: 14535 germ=IGHV1-2*02 seqid1=47.9 seqid3=44.6 thrd1=0.151 thrd3=0.189 divg=0.162 Nucleic acid sequence=SEQ ID NO: 146 Amino acid sequence=SEQ ID NO: 846; Antibody Heavy Chain No: 11019 germ=IGHV1-2*02 seqid1=49.6 seqid3=44.6 thrd1=0.152 thrd3=0.187 divg=0.162 Nucleic acid sequence=SEQ ID NO: 147 Amino acid sequence=SEQ ID NO: 847; Antibody Heavy Chain No: 123937 germ=IGHV1-2*02 seqid1=47.9 seqid3=45.4 thrd1=0.218 thrd3=0.219 divg=0.159 Nucleic acid sequence=SEQ ID NO: 148 Amino acid sequence=SEQ ID NO: 848; Antibody Heavy Chain No: 36310 germ=IGHV1-2*02 seqid1=51.2 seqid3=46.9 thrd1=0.161 thrd3=0.236 divg=0.159 Nucleic acid sequence=SEQ ID NO: 149 Amino acid sequence=SEQ ID NO: 849; Antibody Heavy Chain No: 32707 germ=IGHV1-2*02 seqid1=47.9 seqid3=46.2 thrd1=0.214 thrd3=0.187 divg=0.159 Nucleic acid sequence=SEQ ID NO: 150 Amino acid sequence=SEQ ID NO: 850; Antibody Heavy Chain No: 87704 germ=IGHV1-2*02 seqid1=47.1 seqid3=43.8 thrd1=0.219 thrd3=0.147 divg=0.159 Nucleic acid sequence=SEQ ID NO: 151 Amino acid sequence=SEQ ID NO: 851; Antibody Heavy Chain No: 19098 germ=IGHV1-2*02 seqid1=47.9 seqid3=44.6 thrd1=0.151 thrd3=0.189 divg=0.159 Nucleic acid sequence=SEQ ID NO: 152 Amino acid sequence=SEQ ID NO: 852; Antibody Heavy Chain No: 99181 germ=IGHV1-2*02 seqid1=38.8 seqid3=37.7 thrd1=0.211 thrd3=0.213 divg=0.155 Nucleic acid sequence=SEQ ID NO: 153 Amino acid sequence=SEQ ID NO: 853; Antibody Heavy Chain No: 40537 germ=IGHV1-2*02 seqid1=47.9 seqid3=46.2 thrd1=0.212 thrd3=0.186 divg=0.155 Nucleic acid sequence=SEQ ID NO: 154 Amino acid sequence=SEQ ID NO: 854; Antibody Heavy Chain No: 36907 germ=IGHV1-2*02 seqid1=49.6 seqid3=49.2 thrd1=0.150 thrd3=0.149 divg=0.155 Nucleic acid sequence=SEQ ID NO: 155 Amino acid sequence=SEQ ID NO: 855; Antibody Heavy Chain No: 29608 germ=IGHV1-2*02 seqid1=47.9 seqid3=46.2 thrd1=0.149 thrd3=0.205 divg=0.155 Nucleic acid sequence=SEQ ID NO: 156 Amino acid sequence=SEQ ID NO: 856; Antibody Heavy Chain No: 113080 germ=IGHV1-2*02 seqid1=48.8 seqid3=48.5 thrd1=0.163 thrd3=0.167 divg=0.155 Nucleic acid sequence=SEQ ID NO: 157 Amino acid sequence=SEQ ID NO: 857; Antibody Heavy Chain No: 71038 germ=IGHV1-2*02 seqid1=47.9 seqid3=46.2 thrd1=0.212 thrd3=0.186 divg=0.155 Nucleic acid sequence=SEQ ID NO: 158 Amino acid sequence=SEQ ID NO: 858; Antibody Heavy Chain No: 6143 germ=IGHV1-2*02 seqid1=52.9 seqid3=48.5 thrd1=0.094 thrd3=0.134 divg=0.152 Nucleic acid sequence=SEQ ID NO: 159 Amino acid sequence=SEQ ID NO: 859; Antibody Heavy Chain No: 43158 germ=IGHV1-2*02 seqid1=47.9 seqid3=46.2 thrd1=0.149 thrd3=0.205 divg=0.152 Nucleic acid sequence=SEQ ID NO: 160 Amino acid sequence=SEQ ID NO: 860; Antibody Heavy Chain No: 15966 germ=IGHV1-2*02 seqid1=52.9 seqid3=45.4 thrd1=0.196 thrd3=0.118 divg=0.152 Nucleic acid sequence=SEQ ID NO: 161 Amino acid sequence=SEQ ID NO: 861; Antibody Heavy Chain No: 34203 germ=IGHV1-2*02 seqid1=49.6 seqid3=45.4 thrd1=0.150 thrd3=0.184 divg=0.152 Nucleic acid sequence=SEQ ID NO: 162 Amino acid sequence=SEQ ID NO: 862; Antibody Heavy Chain No: 88799 germ=IGHV1-2*02 seqid1=46.3 seqid3=42.3 thrd1=0.168 thrd3=0.213 divg=0.152 Nucleic acid sequence=SEQ ID NO: 163 Amino acid sequence=SEQ ID NO: 863; Antibody Heavy Chain No: 2164 germ=IGHV1-2*02 seqid1=51.2 seqid3=50.0 thrd1=0.150 thrd3=0.150 divg=0.152 Nucleic acid sequence=SEQ ID NO: 164 Amino acid sequence=SEQ ID NO: 864; Antibody Heavy Chain No: 179552 germ=IGHV1-2*02 seqid1=43.8 seqid3=45.4 thrd1=0.216 thrd3=0.125 divg=0.149 Nucleic acid sequence=SEQ ID NO: 165 Amino acid sequence=SEQ ID NO: 865; Antibody Heavy Chain No: 4734 germ=IGHV1-2*02 seqid1=44.6 seqid3=48.5 thrd1=0.185 thrd3=0.156 divg=0.145 Nucleic acid sequence=SEQ ID NO: 166 Amino acid sequence=SEQ ID NO: 866; Antibody Heavy Chain No: 17242 germ=IGHV1-2*02 seqid1=47.9 seqid3=46.2 thrd1=0.144 thrd3=0.143 divg=0.145 Nucleic acid sequence=SEQ ID NO: 167 Amino acid sequence=SEQ ID NO: 867; Antibody Heavy Chain No: 17884 germ=IGHV1-2*02 seqid1=44.6 seqid3=48.5 thrd1=0.186 thrd3=0.158 divg=0.142 Nucleic acid sequence=SEQ ID NO: 168 Amino acid sequence=SEQ ID NO: 868; Antibody Heavy Chain No: 32382 germ=IGHV1-2*02 seqid1=49.6 seqid3=47.7 thrd1=0.144 thrd3=0.143 divg=0.142 Nucleic acid sequence=SEQ ID NO: 169 Amino acid sequence=SEQ ID NO: 869; Antibody Heavy Chain No: 41962 germ=IGHV1-2*02 seqid1=49.6 seqid3=47.7 thrd1=0.144 thrd3=0.143 divg=0.142 Nucleic acid sequence=SEQ ID NO: 170 Amino acid sequence=SEQ ID NO: 870; Antibody Heavy Chain No: 59875 germ=IGHV1-2*02 seqid1=49.6 seqid3=47.7 thrd1=0.144 thrd3=0.143 divg=0.142 Nucleic acid sequence=SEQ ID NO: 171 Amino acid sequence=SEQ ID NO: 871; Antibody Heavy Chain No: 33133 germ=IGHV1-2*02 seqid1=49.6 seqid3=49.2 thrd1=0.163 thrd3=0.158 divg=0.142 Nucleic acid sequence=SEQ ID NO: 172 Amino acid sequence=SEQ ID NO: 872; Antibody Heavy Chain No: 82539 germ=IGHV1-2*02 seqid1=53.7 seqid3=48.5 thrd1=0.173 thrd3=0.204 divg=0.142 Nucleic acid sequence=SEQ ID NO: 173 Amino acid sequence=SEQ ID NO: 873; Antibody Heavy Chain No: 43232 germ=IGHV1-2*02 seqid1=49.6 seqid3=47.7 thrd1=0.144 thrd3=0.143 divg=0.142 Nucleic acid sequence=SEQ ID NO: 174 Amino acid sequence=SEQ ID NO: 874; Antibody Heavy Chain No: 49896 germ=IGHV1-2*02 seqid1=43.0 seqid3=43.8 thrd1=0.240 thrd3=0.155 divg=0.142 Nucleic acid sequence=SEQ ID NO: 175 Amino acid sequence=SEQ ID NO: 875; Antibody Heavy Chain No: 13144 germ=IGHV1-2*02 seqid1=53.7 seqid3=48.5 thrd1=0.208 thrd3=0.114 divg=0.139 Nucleic acid sequence=SEQ ID NO: 176 Amino acid sequence=SEQ ID NO: 876; Antibody Heavy Chain No: 94912 germ=IGHV1-2*02 seqid1=52.1 seqid3=49.2 thrd1=0.163 thrd3=0.210 divg=0.139 Nucleic acid sequence=SEQ ID NO: 177 Amino acid sequence=SEQ ID NO: 877; Antibody Heavy Chain No: 95649 germ=IGHV1-2*02 seqid1=51.2 seqid3=45.4 thrd1=0.106 thrd3=0.141 divg=0.139 Nucleic acid sequence=SEQ ID NO: 178 Amino acid sequence=SEQ ID NO: 878; Antibody Heavy Chain No: 5273 germ=IGHV1-2*02 seqid1=50.4 seqid3=50.0 thrd1=0.161 thrd3=0.156 divg=0.139 Nucleic acid sequence=SEQ ID NO: 179 Amino acid sequence=SEQ ID NO: 879; Antibody Heavy Chain No: 79693 germ=IGHV1-2*02 seqid1=52.1 seqid3=46.2 thrd1=0.092 thrd3=0.132 divg=0.139 Nucleic acid sequence=SEQ ID NO: 180 Amino acid sequence=SEQ ID NO: 880; Antibody Heavy Chain No: 80554 germ=IGHV1-2*02 seqid1=51.2 seqid3=48.5 thrd1=0.161 thrd3=0.211 divg=0.139 Nucleic acid sequence=SEQ ID NO: 181 Amino acid sequence=SEQ ID NO: 881; Antibody Heavy Chain No: 119108 germ=IGHV1-2*02 seqid1=47.1 seqid3=45.4 thrd1=0.163 thrd3=0.222 divg=0.139 Nucleic acid sequence=SEQ ID NO: 182 Amino acid sequence=SEQ ID NO: 882; Antibody Heavy Chain No: 29950 germ=IGHV1-2*02 seqid1=50.4 seqid3=50.0 thrd1=0.161 thrd3=0.156 divg=0.139 Nucleic acid sequence=SEQ ID NO: 183 Amino acid sequence=SEQ ID NO: 883; Antibody Heavy Chain No: 39089 germ=IGHV1-2*02 seqid1=50.4 seqid3=50.0 thrd1=0.161 thrd3=0.156 divg=0.139 Nucleic acid sequence=SEQ ID NO: 184 Amino acid sequence=SEQ ID NO: 884; Antibody Heavy Chain No: 40410 germ=IGHV1-2*02 seqid1=50.4 seqid3=50.0 thrd1=0.160 thrd3=0.155 divg=0.139 Nucleic acid sequence=SEQ ID NO: 185 Amino acid sequence=SEQ ID NO: 885; Antibody Heavy Chain No: 14930 germ=IGHV1-2*02 seqid1=51.2 seqid3=48.5 thrd1=0.161 thrd3=0.211 divg=0.139 Nucleic acid sequence=SEQ ID NO: 186 Amino acid sequence=SEQ ID NO: 886; Antibody Heavy Chain No: 55973 germ=IGHV1-2*02 seqid1=49.6 seqid3=48.5 thrd1=0.170 thrd3=0.115 divg=0.139 Nucleic acid sequence=SEQ ID NO: 187 Amino acid sequence=SEQ ID NO: 887; Antibody Heavy Chain No: 4040 germ=IGHV1-2*02 seqid1=49.6 seqid3=49.2 thrd1=0.163 thrd3=0.159 divg=0.139 Nucleic acid sequence=SEQ ID NO: 188 Amino acid sequence=SEQ ID NO: 888; Antibody Heavy Chain No: 52215 germ=IGHV1-2*02 seqid1=44.6 seqid3=44.6 thrd1=0.189 thrd3=0.284 divg=0.139 Nucleic acid sequence=SEQ ID NO: 189 Amino acid sequence=SEQ ID NO: 889; Antibody Heavy Chain No: 65622 germ=IGHV1-2*02 seqid1=57.9 seqid3=51.5 thrd1=0.228 thrd3=0.174 divg=0.139 Nucleic acid sequence=SEQ ID NO: 190 Amino acid sequence=SEQ ID NO: 890; Antibody Heavy Chain No: 144394 germ=IGHV1-2*02 seqid1=50.4 seqid3=48.5 thrd1=0.148 thrd3=0.151 divg=0.139 Nucleic acid sequence=SEQ ID NO: 191 Amino acid sequence=SEQ ID NO: 891; Antibody Heavy Chain No: 10658 germ=IGHV1-2*02 seqid1=50.4 seqid3=50.0 thrd1=0.161 thrd3=0.156 divg=0.139 Nucleic acid sequence=SEQ ID NO: 192 Amino acid sequence=SEQ ID NO: 892; Antibody Heavy Chain No: 3811 germ=IGHV1-2*02 seqid1=50.4 seqid3=50.0 thrd1=0.161 thrd3=0.156 divg=0.139 Nucleic acid sequence=SEQ ID NO: 193 Amino acid sequence=SEQ ID NO: 893; Antibody Heavy Chain No: 48101 germ=IGHV1-2*02 seqid1=49.6 seqid3=50.0 thrd1=0.162 thrd3=0.157 divg=0.139 Nucleic acid sequence=SEQ ID NO: 194 Amino acid sequence=SEQ ID NO: 894; Antibody Heavy Chain No: 15636 germ=IGHV1-2*02 seqid1=50.4 seqid3=50.0 thrd1=0.161 thrd3=0.156 divg=0.139 Nucleic acid sequence=SEQ ID NO: 195 Amino acid sequence=SEQ ID NO: 895; Antibody Heavy Chain No: 26505 germ=IGHV1-2*02 seqid1=48.8 seqid3=43.8 thrd1=0.283 thrd3=0.157 divg=0.139 Nucleic acid sequence=SEQ ID NO: 196 Amino acid sequence=SEQ ID NO: 896; Antibody Heavy Chain No: 84089 germ=IGHV1-2*02 seqid1=51.2 seqid3=50.0 thrd1=0.159 thrd3=0.154 divg=0.135 Nucleic acid sequence=SEQ ID NO: 197 Amino acid sequence=SEQ ID NO: 897; Antibody Heavy Chain No: 104154 germ=IGHV1-2*02 seqid1=50.4 seqid3=50.0 thrd1=0.161 thrd3=0.156 divg=0.135 Nucleic acid sequence=SEQ ID NO: 198 Amino acid sequence=SEQ ID NO: 898; Antibody Heavy Chain No: 23977 germ=IGHV1-2*02 seqid1=50.4 seqid3=50.0 thrd1=0.159 thrd3=0.155 divg=0.135 Nucleic acid sequence=SEQ ID NO: 199 Amino acid sequence=SEQ ID NO: 899; Antibody Heavy Chain No: 167681 germ=IGHV1-2*02 seqid1=41.3 seqid3=40.0 thrd1=0.234 thrd3=0.259 divg=0.135 Nucleic acid sequence=SEQ ID NO: 200 Amino acid sequence=SEQ ID NO: 900; Antibody Heavy Chain No: 17288 germ=IGHV1-2*02 seqid1=53.7 seqid3=47.7 thrd1=0.093 thrd3=0.133 divg=0.135 Nucleic acid sequence=SEQ ID NO: 201 Amino acid sequence=SEQ ID NO: 901; Antibody Heavy Chain No: 33637 germ=IGHV1-2*02 seqid1=52.9 seqid3=47.7 thrd1=0.094 thrd3=0.134 divg=0.135 Nucleic acid sequence=SEQ ID NO: 202 Amino acid sequence=SEQ ID NO: 902; Antibody Heavy Chain No: 110259 germ=IGHV1-2*02 seqid1=48.8 seqid3=50.0 thrd1=0.161 thrd3=0.158 divg=0.135 Nucleic acid sequence=SEQ ID NO: 203 Amino acid sequence=SEQ ID NO: 903; Antibody Heavy Chain No: 11461 germ=IGHV1-2*02 seqid1=49.6 seqid3=49.2 thrd1=0.164 thrd3=0.160 divg=0.135 Nucleic acid sequence=SEQ ID NO: 204 Amino acid sequence=SEQ ID NO: 904; Antibody Heavy Chain No: 57309 germ=IGHV1-2*02 seqid1=50.4 seqid3=50.0 thrd1=0.164 thrd3=0.159 divg=0.135 Nucleic acid sequence=SEQ ID NO: 205 Amino acid sequence=SEQ ID NO: 905; Antibody Heavy Chain No: 28613 germ=IGHV1-2*02 seqid1=47.1 seqid3=46.9 thrd1=0.180 thrd3=0.242 divg=0.135 Nucleic acid sequence=SEQ ID NO: 206 Amino acid sequence=SEQ ID NO: 906; Antibody Heavy Chain No: 80786 germ=IGHV1-2*02 seqid1=47.1 seqid3=44.6 thrd1=0.159 thrd3=0.152 divg=0.135 Nucleic acid sequence=SEQ ID NO: 207 Amino acid sequence=SEQ ID NO: 907; Antibody Heavy Chain No: 34770 germ=IGHV1-2*02 seqid1=50.4 seqid3=50.0 thrd1=0.162 thrd3=0.158 divg=0.135 Nucleic acid sequence=SEQ ID NO: 208 Amino acid sequence=SEQ ID NO: 908; Antibody Heavy Chain No: 58396 germ=IGHV1-2*02 seqid1=49.6 seqid3=50.0 thrd1=0.159 thrd3=0.155 divg=0.135 Nucleic acid sequence=SEQ ID NO: 209 Amino acid sequence=SEQ ID NO: 909; Antibody Heavy Chain No: 150271 germ=IGHV1-2*02 seqid1=39.7 seqid3=41.5 thrd1=0.310 thrd3=0.356 divg=0.135 Nucleic acid sequence=SEQ ID NO: 210 Amino acid sequence=SEQ ID NO: 910; Antibody Heavy Chain No: 44015 germ=IGHV1-2*02 seqid1=50.4 seqid3=50.0 thrd1=0.160 thrd3=0.157 divg=0.135 Nucleic acid sequence=SEQ ID NO: 211 Amino acid sequence=SEQ ID NO: 911; Antibody Heavy Chain No: 64391 germ=IGHV1-2*02 seqid1=45.5 seqid3=45.4 thrd1=0.228 thrd3=0.145 divg=0.135 Nucleic acid sequence=SEQ ID NO: 212 Amino acid sequence=SEQ ID NO: 912; Antibody Heavy Chain No: 25120 germ=IGHV1-2*02 seqid1=49.6 seqid3=49.2 thrd1=0.161 thrd3=0.157 divg=0.135 Nucleic acid sequence=SEQ ID NO: 213 Amino acid sequence=SEQ ID NO: 913; Antibody Heavy Chain No: 10614 germ=IGHV1-2*02 seqid1=50.4 seqid3=50.8 thrd1=0.165 thrd3=0.150 divg=0.135 Nucleic acid sequence=SEQ ID NO: 214 Amino acid sequence=SEQ ID NO: 914; Antibody Heavy Chain No: 51689 germ=IGHV1-2*02 seqid1=49.6 seqid3=49.2 thrd1=0.162 thrd3=0.158 divg=0.135 Nucleic acid sequence=SEQ ID NO: 215 Amino acid sequence=SEQ ID NO: 915; Antibody Heavy Chain No: 63801 germ=IGHV1-2*02 seqid1=53.7 seqid3=50.0 thrd1=0.153 thrd3=0.200 divg=0.135 Nucleic acid sequence=SEQ ID NO: 216 Amino acid sequence=SEQ ID NO: 916; Antibody Heavy Chain No: 116007 germ=IGHV1-2*02 seqid1=53.7 seqid3=47.7 thrd1=0.093 thrd3=0.133 divg=0.135 Nucleic acid sequence=SEQ ID NO: 217 Amino acid sequence=SEQ ID NO: 917; Antibody Heavy Chain No: 22483 germ=IGHV1-2*02 seqid1=50.4 seqid3=50.0 thrd1=0.164 thrd3=0.159 divg=0.135 Nucleic acid sequence=SEQ ID NO: 218 Amino acid sequence=SEQ ID NO: 918; Antibody Heavy Chain No: 52322 germ=IGHV1-2*02 seqid1=52.1 seqid3=46.2 thrd1=0.099 thrd3=0.141 divg=0.135 Nucleic acid sequence=SEQ ID NO: 219 Amino acid sequence=SEQ ID NO: 919; Antibody Heavy Chain No: 88747 germ=IGHV1-2*02 seqid1=47.1 seqid3=46.9 thrd1=0.165 thrd3=0.160 divg=0.135 Nucleic acid sequence=SEQ ID NO: 220 Amino acid sequence=SEQ ID NO: 920; Antibody Heavy Chain No: 35449 germ=IGHV1-2*02 seqid1=53.7 seqid3=47.7 thrd1=0.093 thrd3=0.135 divg=0.135 Nucleic acid sequence=SEQ ID NO: 221 Amino acid sequence=SEQ ID NO: 921; Antibody Heavy Chain No: 18812 germ=IGHV1-2*02 seqid1=49.6 seqid3=49.2 thrd1=0.157 thrd3=0.153 divg=0.135 Nucleic acid sequence=SEQ ID NO: 222 Amino acid sequence=SEQ ID NO: 922; Antibody Heavy Chain No: 69878 germ=IGHV1-2*02 seqid1=49.6 seqid3=50.0 thrd1=0.149 thrd3=0.121 divg=0.135 Nucleic acid sequence=SEQ ID NO: 223 Amino acid sequence=SEQ ID NO: 923; Antibody Heavy Chain No: 78844 germ=IGHV1-2*02 seqid1=50.4 seqid3=47.7 thrd1=0.150 thrd3=0.143 divg=0.135 Nucleic acid sequence=SEQ ID NO: 224 Amino acid sequence=SEQ ID NO: 924; Antibody Heavy Chain No: 79855 germ=IGHV1-2*02 seqid1=43.0 seqid3=43.8 thrd1=0.262 thrd3=0.267 divg=0.135 Nucleic acid sequence=SEQ ID NO: 225 Amino acid sequence=SEQ ID NO: 925; Antibody Heavy Chain No: 59636 germ=IGHV1-2*02 seqid1=50.4 seqid3=50.0 thrd1=0.162 thrd3=0.158 divg=0.135 Nucleic acid sequence=SEQ ID NO: 226 Amino acid sequence=SEQ ID NO: 926; Antibody Heavy Chain No: 81201 germ=IGHV1-2*02 seqid1=50.4 seqid3=50.0 thrd1=0.161 thrd3=0.157 divg=0.135 Nucleic acid sequence=SEQ ID NO: 227 Amino acid sequence=SEQ ID NO: 927; Antibody Heavy Chain No: 72731 germ=IGHV1-2*02 seqid1=49.6 seqid3=50.0 thrd1=0.160 thrd3=0.155 divg=0.135 Nucleic acid sequence=SEQ ID NO: 228 Amino acid sequence=SEQ ID NO: 928; Antibody Heavy Chain No: 195439 germ=IGHV1-2*02 seqid1=49.6 seqid3=45.4 thrd1=0.123 thrd3=0.107 divg=0.135 Nucleic acid sequence=SEQ ID NO: 229 Amino acid sequence=SEQ ID NO: 929; Antibody Heavy Chain No: 52914 germ=IGHV1-2*02 seqid1=51.2 seqid3=50.0 thrd1=0.282 thrd3=0.176 divg=0.135 Nucleic acid sequence=SEQ ID NO: 230 Amino acid sequence=SEQ ID NO: 930; Antibody Heavy Chain No: 74803 germ=IGHV1-2*02 seqid1=53.7 seqid3=47.7 thrd1=0.093 thrd3=0.133 divg=0.135 Nucleic acid sequence=SEQ ID NO: 231 Amino acid sequence=SEQ ID NO: 931; Antibody Heavy Chain No: 74459 germ=IGHV1-2*02 seqid1=50.4 seqid3=50.8 thrd1=0.160 thrd3=0.155 divg=0.135 Nucleic acid sequence=SEQ ID NO: 232 Amino acid sequence=SEQ ID NO: 932; Antibody Heavy Chain No: 7871 germ=IGHV1-2*02 seqid1=52.1 seqid3=47.7 thrd1=0.201 thrd3=0.127 divg=0.135 Nucleic acid sequence=SEQ ID NO: 233 Amino acid sequence=SEQ ID NO: 933; Antibody Heavy Chain No: 20841 germ=IGHV1-2*02 seqid1=53.7 seqid3=47.7 thrd1=0.093 thrd3=0.133 divg=0.135 Nucleic acid sequence=SEQ ID NO: 234 Amino acid sequence=SEQ ID NO: 934; Antibody Heavy Chain No: 37716 germ=IGHV1-2*02 seqid1=49.6 seqid3=49.2 thrd1=0.160 thrd3=0.156 divg=0.135 Nucleic acid sequence=SEQ ID NO: 235 Amino acid sequence=SEQ ID NO: 935; Antibody Heavy Chain No: 39615 germ=IGHV1-2*02 seqid1=50.4 seqid3=47.7 thrd1=0.150 thrd3=0.143 divg=0.135 Nucleic acid sequence=SEQ ID NO: 236 Amino acid sequence=SEQ ID NO: 936; Antibody Heavy Chain No: 66215 germ=IGHV1-2*02 seqid1=50.4 seqid3=50.0 thrd1=0.160 thrd3=0.155 divg=0.135 Nucleic acid sequence=SEQ ID NO: 237 Amino acid sequence=SEQ ID NO: 937; Antibody Heavy Chain No: 82019 germ=IGHV1-2*02 seqid1=49.6 seqid3=49.2 thrd1=0.165 thrd3=0.163 divg=0.135 Nucleic acid sequence=SEQ ID NO: 238 Amino acid sequence=SEQ ID NO: 938; Antibody Heavy Chain No: 21464 germ=IGHV1-2*02 seqid1=51.2 seqid3=50.0 thrd1=0.162 thrd3=0.156 divg=0.135 Nucleic acid sequence=SEQ ID NO: 239 Amino acid sequence=SEQ ID NO: 939; Antibody Heavy Chain No: 105467 germ=IGHV1-

2*02 seqid1=49.6 seqid3=47.7 thrd1=0.167 thrd3=0.164 divg=0.135 Nucleic acid sequence=SEQ ID NO: 240 Amino acid sequence=SEQ ID NO: 940; Antibody Heavy Chain No: 60368 germ=IGHV1-2*02 seqid1=50.4 seqid3=50.0 thrd1=0.161 thrd3=0.156 divg=0.135 Nucleic acid sequence=SEQ ID NO: 241 Amino acid sequence=SEQ ID NO: 941; Antibody Heavy Chain No: 113424 germ=IGHV1-2*02 seqid1=50.4 seqid3=50.0 thrd1=0.161 thrd3=0.156 divg=0.132 Nucleic acid sequence=SEQ ID NO: 242 Amino acid sequence=SEQ ID NO: 942; Antibody Heavy Chain No: 87796 germ=IGHV1-2*02 seqid1=50.4 seqid3=50.0 thrd1=0.161 thrd3=0.156 divg=0.132 Nucleic acid sequence=SEQ ID NO: 243 Amino acid sequence=SEQ ID NO: 943; Antibody Heavy Chain No: 107864 germ=IGHV1-2*02 seqid1=50.4 seqid3=50.0 thrd1=0.161 thrd3=0.156 divg=0.132 Nucleic acid sequence=SEQ ID NO: 244 Amino acid sequence=SEQ ID NO: 944; Antibody Heavy Chain No: 128805 germ=IGHV1-2*02 seqid1=48.8 seqid3=47.7 thrd1=0.153 thrd3=0.162 divg=0.132 Nucleic acid sequence=SEQ ID NO: 245 Amino acid sequence=SEQ ID NO: 945; Antibody Heavy Chain No: 38060 germ=IGHV1-2*02 seqid1=50.4 seqid3=50.0 thrd1=0.161 thrd3=0.156 divg=0.132 Nucleic acid sequence=SEQ ID NO: 246 Amino acid sequence=SEQ ID NO: 946; Antibody Heavy Chain No: 97440 germ=IGHV1-2*02 seqid1=48.8 seqid3=48.5 thrd1=0.165 thrd3=0.162 divg=0.132 Nucleic acid sequence=SEQ ID NO: 247 Amino acid sequence=SEQ ID NO: 947; Antibody Heavy Chain No: 66266 germ=IGHV1-2*02 seqid1=50.4 seqid3=50.0 thrd1=0.161 thrd3=0.156 divg=0.132 Nucleic acid sequence=SEQ ID NO: 248 Amino acid sequence=SEQ ID NO: 948; Antibody Heavy Chain No: 39042 germ=IGHV1-2*02 seqid1=49.6 seqid3=50.0 thrd1=0.159 thrd3=0.138 divg=0.132 Nucleic acid sequence=SEQ ID NO: 249 Amino acid sequence=SEQ ID NO: 949; Antibody Heavy Chain No: 94534 germ=IGHV1-2*02 seqid1=50.4 seqid3=50.0 thrd1=0.161 thrd3=0.156 divg=0.132 Nucleic acid sequence=SEQ ID NO: 250 Amino acid sequence=SEQ ID NO: 950; Antibody Heavy Chain No: 94385 germ=IGHV1-2*02 seqid1=50.4 seqid3=50.0 thrd1=0.161 thrd3=0.156 divg=0.132 Nucleic acid sequence=SEQ ID NO: 251 Amino acid sequence=SEQ ID NO: 951; Antibody Heavy Chain No: 76265 germ=IGHV1-2*02 seqid1=50.4 seqid3=50.0 thrd1=0.161 thrd3=0.156 divg=0.132 Nucleic acid sequence=SEQ ID NO: 252 Amino acid sequence=SEQ ID NO: 952; Antibody Heavy Chain No: 22535 germ=IGHV1-2*02 seqid1=50.4 seqid3=50.0 thrd1=0.161 thrd3=0.156 divg=0.132 Nucleic acid sequence=SEQ ID NO: 253 Amino acid sequence=SEQ ID NO: 953; Antibody Heavy Chain No: 85110 germ=IGHV1-2*02 seqid1=53.7 seqid3=47.7 thrd1=0.093 thrd3=0.133 divg=0.132 Nucleic acid sequence=SEQ ID NO: 254 Amino acid sequence=SEQ ID NO: 954; Antibody Heavy Chain No: 168379 germ=IGHV1-2*02 seqid1=50.4 seqid3=49.2 thrd1=0.162 thrd3=0.157 divg=0.132 Nucleic acid sequence=SEQ ID NO: 255 Amino acid sequence=SEQ ID NO: 955; Antibody Heavy Chain No: 112172 germ=IGHV1-2*02 seqid1=50.4 seqid3=44.6 thrd1=0.105 thrd3=0.149 divg=0.132 Nucleic acid sequence=SEQ ID NO: 256 Amino acid sequence=SEQ ID NO: 956; Antibody Heavy Chain No: 47329 germ=IGHV1-2*02 seqid1=50.4 seqid3=50.0 thrd1=0.161 thrd3=0.156 divg=0.132 Nucleic acid sequence=SEQ ID NO: 257 Amino acid sequence=SEQ ID NO: 957; Antibody Heavy Chain No: 38803 germ=IGHV1-2*02 seqid1=50.4 seqid3=50.0 thrd1=0.161 thrd3=0.156 divg=0.132 Nucleic acid sequence=SEQ ID NO: 258 Amino acid sequence=SEQ ID NO: 958; Antibody Heavy Chain No: 42945 germ=IGHV1-2*02 seqid1=50.4 seqid3=50.0 thrd1=0.161 thrd3=0.156 divg=0.132 Nucleic acid sequence=SEQ ID NO: 259 Amino acid sequence=SEQ ID NO: 959; Antibody Heavy Chain No: 55338 germ=IGHV1-2*02 seqid1=50.4 seqid3=50.0 thrd1=0.161 thrd3=0.156 divg=0.132 Nucleic acid sequence=SEQ ID NO: 260 Amino acid sequence=SEQ ID NO: 960; Antibody Heavy Chain No: 53837 germ=IGHV1-2*02 seqid1=53.7 seqid3=47.7 thrd1=0.093 thrd3=0.133 divg=0.132 Nucleic acid sequence=SEQ ID NO: 261 Amino acid sequence=SEQ ID NO: 961; Antibody Heavy Chain No: 73759 germ=IGHV1-2*02 seqid1=50.4 seqid3=50.0 thrd1=0.161 thrd3=0.156 divg=0.132 Nucleic acid sequence=SEQ ID NO: 262 Amino acid sequence=SEQ ID NO: 962; Antibody Heavy Chain No: 131368 germ=IGHV1-2*02 seqid1=50.4 seqid3=50.0 thrd1=0.161 thrd3=0.156 divg=0.132 Nucleic acid sequence=SEQ ID NO: 263 Amino acid sequence=SEQ ID NO: 963; Antibody Heavy Chain No: 80330 germ=IGHV1-2*02 seqid1=50.4 seqid3=50.0 thrd1=0.161 thrd3=0.156 divg=0.132 Nucleic acid sequence=SEQ ID NO: 264 Amino acid sequence=SEQ ID NO: 964; Antibody Heavy Chain No: 52164 germ=IGHV1-2*02 seqid1=50.4 seqid3=50.0 thrd1=0.161 thrd3=0.156 divg=0.132 Nucleic acid sequence=SEQ ID NO: 265 Amino acid sequence=SEQ ID NO: 965; Antibody Heavy Chain No: 52134 germ=IGHV1-2*02 seqid1=50.4 seqid3=50.0 thrd1=0.161 thrd3=0.156 divg=0.132 Nucleic acid sequence=SEQ ID NO: 266 Amino acid sequence=SEQ ID NO: 966; Antibody Heavy Chain No: 53605 germ=IGHV1-2*02 seqid1=51.2 seqid3=46.9 thrd1=0.172 thrd3=0.222 divg=0.132 Nucleic acid sequence=SEQ ID NO: 267 Amino acid sequence=SEQ ID NO: 967; Antibody Heavy Chain No: 129544 germ=IGHV1-2*02 seqid1=53.7 seqid3=47.7 thrd1=0.093 thrd3=0.133 divg=0.132 Nucleic acid sequence=SEQ ID NO: 268 Amino acid sequence=SEQ ID NO: 968; Antibody Heavy Chain No: 28518 germ=IGHV1-2*02 seqid1=54.5 seqid3=50.0 thrd1=0.179 thrd3=0.175 divg=0.132 Nucleic acid sequence=SEQ ID NO: 269 Amino acid sequence=SEQ ID NO: 969; Antibody Heavy Chain No: 38525 germ=IGHV1-2*02 seqid1=50.4 seqid3=50.0 thrd1=0.161 thrd3=0.156 divg=0.132 Nucleic acid sequence=SEQ ID NO: 270 Amino acid sequence=SEQ ID NO: 970; Antibody Heavy Chain No: 88750 germ=IGHV1-2*02 seqid1=50.4 seqid3=50.0 thrd1=0.161 thrd3=0.156 divg=0.132 Nucleic acid sequence=SEQ ID NO: 271 Amino acid sequence=SEQ ID NO: 971; Antibody Heavy Chain No: 26549 germ=IGHV1-2*02 seqid1=50.4 seqid3=49.2 thrd1=0.159 thrd3=0.175 divg=0.132 Nucleic acid sequence=SEQ ID NO: 272 Amino acid sequence=SEQ ID NO: 972; Antibody Heavy Chain No: 7631 germ=IGHV1-2*02 seqid1=53.7 seqid3=47.7 thrd1=0.093 thrd3=0.133 divg=0.132 Nucleic acid sequence=SEQ ID NO: 273 Amino acid sequence=SEQ ID NO: 973; Antibody Heavy Chain No: 130129 germ=IGHV1-2*02 seqid1=48.8 seqid3=49.2 thrd1=0.159 thrd3=0.153 divg=0.132 Nucleic acid sequence=SEQ ID NO: 274 Amino acid sequence=SEQ ID NO: 974; Antibody Heavy Chain No: 16331 germ=IGHV1-2*02 seqid1=50.4 seqid3=50.0 thrd1=0.161 thrd3=0.156 divg=0.132 Nucleic acid sequence=SEQ ID NO: 275 Amino acid sequence=SEQ ID NO: 975; Antibody Heavy Chain No: 60175 germ=IGHV1-2*02 seqid1=50.4 seqid3=49.2 thrd1=0.160 thrd3=0.156 divg=0.132 Nucleic acid sequence=SEQ ID NO: 276 Amino acid sequence=SEQ ID NO: 976; Antibody Heavy Chain No: 171282 germ=IGHV1-2*02 seqid1=51.2 seqid3=51.5 thrd1=0.153 thrd3=0.192 divg=0.132 Nucleic acid sequence=SEQ ID NO: 277 Amino acid sequence=SEQ ID NO: 977; Antibody Heavy Chain No: 63220 germ=IGHV1-2*02 seqid1=50.4 seqid3=50.0 thrd1=0.161 thrd3=0.156 divg=0.132 Nucleic acid sequence=SEQ ID NO: 278 Amino acid sequence=SEQ ID NO: 978; Antibody Heavy Chain No: 53630 germ=IGHV1-2*02 seqid1=50.4 seqid3=47.7 thrd1=0.232 thrd3=0.169 divg=0.132 Nucleic acid sequence=SEQ ID NO: 279 Amino acid sequence=SEQ ID NO: 979; Antibody Heavy Chain No: 31451 germ=IGHV1-2*02 seqid1=50.4 seqid3=50.0 thrd1=0.161 thrd3=0.156 divg=0.132 Nucleic acid sequence=SEQ ID NO: 280 Amino acid sequence=SEQ ID NO: 980; Antibody Heavy Chain No: 40126 germ=IGHV1-2*02 seqid1=49.6 seqid3=48.5 thrd1=0.166 thrd3=0.164 divg=0.132 Nucleic acid sequence=SEQ ID NO: 281 Amino acid sequence=SEQ ID NO: 981; Antibody Heavy Chain No: 66324 germ=IGHV1-2*02 seqid1=50.4 seqid3=50.0 thrd1=0.161 thrd3=0.156 divg=0.132 Nucleic acid sequence=SEQ ID NO: 282 Amino acid sequence=SEQ ID NO: 982; Antibody Heavy Chain No: 13887 germ=IGHV1-2*02 seqid1=43.0 seqid3=44.6 thrd1=0.258 thrd3=0.192 divg=0.132 Nucleic acid sequence=SEQ ID NO: 283 Amino acid sequence=SEQ ID NO: 983; Antibody Heavy Chain No: 27307 germ=IGHV1-2*02 seqid1=50.4 seqid3=50.0 thrd1=0.161 thrd3=0.156 divg=0.132 Nucleic acid sequence=SEQ ID NO: 284 Amino acid sequence=SEQ ID NO: 984; Antibody Heavy Chain No: 26779 germ=IGHV1-2*02 seqid1=50.4 seqid3=50.0 thrd1=0.161 thrd3=0.156 divg=0.132 Nucleic acid sequence=SEQ ID NO: 285 Amino acid sequence=SEQ ID NO: 985; Antibody Heavy Chain No: 171898 germ=IGHV1-2*02 seqid1=53.7 seqid3=47.7 thrd1=0.093 thrd3=0.133 divg=0.132 Nucleic acid sequence=SEQ ID NO: 286 Amino acid sequence=SEQ ID NO: 986; Antibody Heavy Chain No: 13137 germ=IGHV1-2*02 seqid1=50.4 seqid3=50.0 thrd1=0.161 thrd3=0.156 divg=0.132 Nucleic acid sequence=SEQ ID NO: 287 Amino acid sequence=SEQ ID NO: 987; Antibody Heavy Chain No: 87705 germ=IGHV1-2*02 seqid1=53.7 seqid3=47.7 thrd1=0.093 thrd3=0.133 divg=0.132 Nucleic acid sequence=SEQ ID NO: 288 Amino acid sequence=SEQ ID NO: 988; Antibody Heavy Chain No: 113257 germ=IGHV1-2*02 seqid1=50.4 seqid3=50.0 thrd1=0.161 thrd3=0.156 divg=0.132 Nucleic acid sequence=SEQ ID NO: 289 Amino acid sequence=SEQ ID NO: 989; Antibody Heavy Chain No: 29451 germ=IGHV1-2*02 seqid1=50.4 seqid3=50.0 thrd1=0.161 thrd3=0.156 divg=0.132 Nucleic acid sequence=SEQ ID NO: 290 Amino acid sequence=SEQ ID NO: 990; Antibody Heavy Chain No: 163834 germ=IGHV1-2*02 seqid1=47.1 seqid3=45.4 thrd1=0.188 thrd3=0.188 divg=0.132 Nucleic acid sequence=SEQ ID NO: 291 Amino acid sequence=SEQ ID NO: 991; Antibody Heavy Chain No: 99313 germ=IGHV1-2*02 seqid1=49.6 seqid3=43.1 thrd1=0.099 thrd3=0.136 divg=0.132 Nucleic acid sequence=SEQ ID NO: 292 Amino acid sequence=SEQ ID NO: 992; Antibody Heavy Chain No: 94039 germ=IGHV1-2*02 seqid1=50.4 seqid3=50.0 thrd1=0.161 thrd3=0.156 divg=0.132 Nucleic acid sequence=SEQ ID NO: 293 Amino acid sequence=SEQ ID NO: 993; Antibody Heavy Chain No: 44862 germ=IGHV1-2*02 seqid1=50.4 seqid3=50.0 thrd1=0.161 thrd3=0.156 divg=0.132 Nucleic acid sequence=SEQ ID NO: 294 Amino acid sequence=SEQ ID NO: 994; Antibody Heavy Chain No: 90451 germ=IGHV1-2*02 seqid1=49.6 seqid3=49.2 thrd1=0.160 thrd3=0.156 divg=0.132 Nucleic acid sequence=SEQ ID NO: 295 Amino acid sequence=SEQ ID NO: 995; Antibody Heavy Chain No: 62365 germ=IGHV1-2*02 seqid1=50.4 seqid3=50.0 thrd1=0.161 thrd3=0.156 divg=0.132 Nucleic acid sequence=SEQ ID NO: 296 Amino acid sequence=SEQ ID NO: 996; Antibody Heavy Chain No: 137307 germ=IGHV1-2*02 seqid1=40.5 seqid3=41.5 thrd1=0.187 thrd3=0.183 divg=0.132 Nucleic acid sequence=SEQ ID NO: 297 Amino acid sequence=SEQ ID NO: 997; Antibody Heavy Chain No: 35237 germ=IGHV1-2*02 seqid1=53.7 seqid3=47.7 thrd1=0.093 thrd3=0.133 divg=0.132 Nucleic acid sequence=SEQ ID NO: 298 Amino acid sequence=SEQ ID NO: 998; Antibody Heavy Chain No: 85861 germ=IGHV1-2*02 seqid1=50.4 seqid3=50.0 thrd1=0.161 thrd3=0.156 divg=0.132 Nucleic acid sequence=SEQ ID NO: 299 Amino acid sequence=SEQ ID NO: 999; Antibody Heavy Chain No: 44765 germ=IGHV1-2*02 seqid1=50.4 seqid3=50.0 thrd1=0.161 thrd3=0.156 divg=0.132 Nucleic acid sequence=SEQ ID NO: 300 Amino acid sequence=SEQ ID NO: 1000; Antibody Heavy Chain No: 64006 germ=IGHV1-2*02 seqid1=50.4 seqid3=50.0 thrd1=0.161 thrd3=0.156 divg=0.132 Nucleic acid sequence=SEQ ID NO: 301 Amino acid sequence=SEQ ID NO: 1001; Antibody Heavy Chain No: 30706 germ=IGHV1-2*02 seqid1=50.4 seqid3=50.0 thrd1=0.161 thrd3=0.156 divg=0.132 Nucleic acid sequence=SEQ ID NO: 302 Amino acid sequence=SEQ ID NO: 1002; Antibody Heavy Chain No: 66921 germ=IGHV1-2*02 seqid1=50.4 seqid3=50.0 thrd1=0.161 thrd3=0.156 divg=0.132 Nucleic acid sequence=SEQ ID NO: 303 Amino acid sequence=SEQ ID NO: 1003; Antibody Heavy Chain No: 56340 germ=IGHV1-2*02 seqid1=50.4 seqid3=50.0 thrd1=0.161 thrd3=0.156 divg=0.132 Nucleic acid sequence=SEQ ID NO: 304 Amino acid sequence=SEQ ID NO: 1004; Antibody Heavy Chain No: 54385 germ=IGHV1-2*02 seqid1=50.4 seqid3=50.0 thrd1=0.161 thrd3=0.156 divg=0.132 Nucleic acid sequence=SEQ ID NO: 305 Amino acid sequence=SEQ ID NO: 1005; Antibody Heavy Chain No: 107464 germ=IGHV1-2*02 seqid1=50.4 seqid3=50.0 thrd1=0.161 thrd3=0.156 divg=0.132 Nucleic acid sequence=SEQ ID NO: 306 Amino acid sequence=SEQ ID NO: 1006; Antibody Heavy Chain No: 72997 germ=IGHV1-2*02 seqid1=50.4 seqid3=50.0 thrd1=0.161 thrd3=0.156 divg=0.132 Nucleic acid sequence=SEQ ID NO: 307 Amino acid sequence=SEQ ID NO: 1007; Antibody Heavy Chain No: 122440 germ=IGHV1-2*02 seqid1=48.8 seqid3=48.5 thrd1=0.161 thrd3=0.156 divg=0.132 Nucleic acid sequence=SEQ ID NO: 308 Amino acid sequence=SEQ ID NO: 1008; Antibody Heavy Chain No: 51611 germ=IGHV1-2*02 seqid1=50.4 seqid3=50.0 thrd1=0.161 thrd3=0.156 divg=0.132 Nucleic acid sequence=SEQ ID NO: 309 Amino acid sequence=SEQ ID NO: 1009; Antibody Heavy Chain No: 47198 germ=IGHV1-2*02 seqid1=50.4 seqid3=50.0 thrd1=0.161 thrd3=0.156 divg=0.132 Nucleic acid sequence=SEQ ID NO: 310 Amino acid sequence=SEQ ID NO: 1010; Antibody Heavy Chain No: 90259 germ=IGHV1-2*02 seqid1=53.7 seqid3=47.7 thrd1=0.093 thrd3=0.133 divg=0.132 Nucleic acid sequence=SEQ ID NO: 311 Amino acid sequence=SEQ ID NO: 1011; Antibody Heavy Chain No: 81876 germ=IGHV1-2*02 seqid1=50.4 seqid3=50.0 thrd1=0.161 thrd3=0.156 divg=0.132 Nucleic acid sequence=SEQ ID NO: 312 Amino acid sequence=SEQ ID NO: 1012; Antibody Heavy Chain No: 89609 germ=IGHV1-2*02 seqid1=50.4 seqid3=50.0 thrd1=0.161 thrd3=0.156 divg=0.132 Nucleic acid sequence=SEQ ID NO: 313 Amino acid sequence=SEQ ID NO: 1013; Antibody Heavy Chain No: 35904 germ=IGHV1-2*02 seqid1=53.7 seqid3=47.7 thrd1=0.096 thrd3=0.137 divg=0.132 Nucleic acid sequence=SEQ ID NO: 314 Amino acid sequence=SEQ ID NO: 1014; Antibody Heavy Chain No: 111059 germ=IGHV1-2*02 seqid1=50.4 seqid3=50.0 thrd1=0.161 thrd3=0.156 divg=0.132 Nucleic acid sequence=SEQ ID NO: 315 Amino acid sequence=SEQ ID NO: 1015; Antibody Heavy Chain No: 16161 germ=IGHV1-2*02 seqid1=50.4 seqid3=50.0 thrd1=0.161 thrd3=0.156 divg=0.132 Nucleic acid sequence=SEQ ID NO: 316 Amino acid sequence=SEQ ID NO: 1016; Antibody Heavy Chain No: 110880 germ=IGHV1-2*02 seqid1=53.7 seqid3=47.7 thrd1=0.093 thrd3=0.133 divg=0.132 Nucleic acid sequence=SEQ ID NO: 317 Amino acid sequence=SEQ ID NO: 1017; Antibody Heavy Chain No: 14765 germ=IGHV1-2*02 seqid1=50.4 seqid3=50.0 thrd1=0.161 thrd3=0.156 divg=0.132 Nucleic acid sequence=SEQ ID NO: 318 Amino acid sequence=SEQ ID NO: 1018; Antibody Heavy Chain No: 84533 germ=IGHV1-2*02 seqid1=50.4 seqid3=50.0 thrd1=0.161 thrd3=0.156 divg=0.132 Nucleic acid sequence=SEQ ID NO: 319 Amino acid sequence=SEQ ID NO: 1019; Antibody Heavy Chain No: 66611 germ=IGHV1-2*02 seqid1=48.8 seqid3=47.7 thrd1=0.153 thrd3=0.162 divg=0.132 Nucleic acid sequence=SEQ ID NO: 320 Amino acid sequence=SEQ ID NO: 1020; Antibody Heavy Chain No: 8697 germ=IGHV1-2*02 seqid1=53.7 seqid3=47.7 thrd1=0.093 thrd3=0.133 divg=0.132 Nucleic acid sequence=SEQ ID NO: 321 Amino acid sequence=SEQ ID NO: 1021; Antibody Heavy Chain No: 164229 germ=IGHV1-2*02 seqid1=50.4 seqid3=43.8 thrd1=0.171 thrd3=0.168 divg=0.132 Nucleic acid sequence=SEQ ID NO: 322 Amino acid sequence=SEQ ID NO: 1022; Antibody Heavy Chain No: 31295 germ=IGHV1-2*02 seqid1=53.7 seqid3=47.7 thrd1=0.093 thrd3=0.133 divg=0.132 Nucleic acid sequence=SEQ ID NO: 323 Amino acid sequence=SEQ ID NO: 1023; Antibody Heavy Chain No: 25528 germ=IGHV1-2*02 seqid1=50.4 seqid3=50.0 thrd1=0.161 thrd3=0.156 divg=0.132 Nucleic acid sequence=SEQ ID NO: 324 Amino acid sequence=SEQ ID NO: 1024; Antibody Heavy Chain No: 83584 germ=IGHV1-2*02 seqid1=50.4 seqid3=50.0 thrd1=0.161 thrd3=0.156 divg=0.132 Nucleic acid sequence=SEQ ID NO: 325 Amino acid sequence=SEQ ID NO: 1025; Antibody Heavy Chain No: 40574 germ=IGHV1-2*02 seqid1=50.4 seqid3=50.0 thrd1=0.161 thrd3=0.156 divg=0.132 Nucleic acid sequence=SEQ ID NO: 326 Amino acid sequence=SEQ ID NO: 1026; Antibody Heavy Chain No: 118566 germ=IGHV1-2*02 seqid1=53.7 seqid3=47.7 thrd1=0.093 thrd3=0.133 divg=0.132 Nucleic acid sequence=SEQ ID NO: 327 Amino acid sequence=SEQ ID NO: 1027; Antibody Heavy Chain No: 64619 germ=IGHV1-2*02 seqid1=53.7 seqid3=47.7 thrd1=0.093 thrd3=0.133 divg=0.132 Nucleic acid sequence=SEQ ID NO: 328 Amino acid sequence=SEQ ID NO: 1028; Antibody Heavy Chain No: 112548 germ=IGHV1-2*02 seqid1=50.4 seqid3=50.0 thrd1=0.161 thrd3=0.156 divg=0.132 Nucleic acid sequence=SEQ ID NO: 329 Amino acid sequence=SEQ ID NO: 1029; Antibody Heavy Chain No: 80024 germ=IGHV1-2*02 seqid1=47.9 seqid3=47.7 thrd1=0.160 thrd3=0.155 divg=0.132 Nucleic acid sequence=SEQ ID NO: 330 Amino acid sequence=SEQ ID NO: 1030; Antibody Heavy Chain No: 53014 germ=IGHV1-2*02 seqid1=50.4 seqid3=50.0 thrd1=0.161 thrd3=0.156 divg=0.132 Nucleic acid sequence=SEQ ID NO: 331 Amino acid sequence=SEQ ID NO: 1031; Antibody Heavy Chain No: 22889 germ=IGHV1-2*02 seqid1=50.4 seqid3=50.0 thrd1=0.161 thrd3=0.156 divg=0.132 Nucleic acid sequence=SEQ ID NO: 332 Amino acid sequence=SEQ ID NO: 1032; Antibody Heavy Chain No: 20603 germ=IGHV1-2*02 seqid1=52.1 seqid3=46.2 thrd1=0.093 thrd3=0.133 divg=0.132 Nucleic acid sequence=SEQ ID NO: 333 Amino acid sequence=SEQ ID NO: 1033; Antibody Heavy Chain No: 95127 germ=IGHV1-2*02 seqid1=50.4 seqid3=50.0 thrd1=0.161 thrd3=0.156 divg=0.132 Nucleic acid sequence=SEQ ID NO: 334 Amino acid sequence=SEQ ID NO: 1034; Antibody Heavy Chain No: 40882 germ=IGHV1-2*02 seqid1=50.4 seqid3=50.0 thrd1=0.161 thrd3=0.156 divg=0.132 Nucleic acid sequence=SEQ ID NO: 335 Amino acid sequence=SEQ ID NO: 1035; Antibody Heavy Chain No: 12779 germ=IGHV1-2*02 seqid1=50.4 seqid3=50.0 thrd1=0.161 thrd3=0.156 divg=0.132 Nucleic acid sequence=SEQ ID NO: 336 Amino acid sequence=SEQ ID NO: 1036; Antibody Heavy Chain No: 30393 germ=IGHV1-2*02 seqid1=50.4 seqid3=50.0 thrd1=0.161 thrd3=0.156 divg=0.132 Nucleic acid sequence=SEQ ID NO: 337 Amino acid sequence=SEQ ID NO: 1037; Antibody Heavy Chain No: 44033 germ=IGHV1-2*02 seqid1=50.4 seqid3=50.0 thrd1=0.161 thrd3=0.156 divg=0.132 Nucleic acid sequence=SEQ ID NO: 338 Amino acid sequence=SEQ ID NO: 1038; Antibody Heavy Chain No: 13199 germ=IGHV1-2*02 seqid1=50.4 seqid3=50.0 thrd1=0.161 thrd3=0.156 divg=0.132 Nucleic acid sequence=SEQ ID NO: 339 Amino acid sequence=SEQ ID NO: 1039; Antibody Heavy Chain No: 32566 germ=IGHV1-2*02 seqid1=50.4 seqid3=50.0 thrd1=0.161 thrd3=0.156 divg=0.132 Nucleic acid sequence=SEQ ID NO: 340 Amino acid sequence=SEQ ID NO: 1040; Antibody Heavy Chain No: 64977 germ=IGHV1-2*02 seqid1=48.8 seqid3=47.7 thrd1=0.153 thrd3=0.162 divg=0.132 Nucleic acid sequence=SEQ ID NO: 341 Amino acid sequence=SEQ ID NO: 1041; Antibody Heavy Chain No: 83943 germ=IGHV1-2*02 seqid1=50.4 seqid3=50.0 thrd1=0.161 thrd3=0.156 divg=0.132 Nucleic acid sequence=SEQ ID NO: 342 Amino acid sequence=SEQ ID NO: 1042; Antibody Heavy Chain No: 93877 germ=IGHV1-2*02 seqid1=50.4 seqid3=44.6 thrd1=0.125 thrd3=0.189 divg=0.132 Nucleic acid sequence=SEQ ID NO: 343 Amino acid sequence=SEQ ID NO: 1043; Antibody Heavy Chain No: 18689 germ=IGHV1-2*02 seqid1=50.4 seqid3=50.0 thrd1=0.161 thrd3=0.156 divg=0.132 Nucleic acid sequence=SEQ ID NO: 344 Amino acid sequence=SEQ ID NO: 1044; Antibody Heavy Chain No: 29339 germ=IGHV1-2*02 seqid1=50.4 seqid3=50.0 thrd1=0.161 thrd3=0.156 divg=0.132 Nucleic acid sequence=SEQ ID NO: 345 Amino acid sequence=SEQ ID NO: 1045; Antibody Heavy Chain No: 63209 germ=IGHV1-2*02 seqid1=53.7 seqid3=47.7 thrd1=0.093 thrd3=0.133 divg=0.132 Nucleic acid sequence=SEQ ID NO: 346 Amino acid sequence=SEQ ID NO: 1046; Antibody Heavy Chain No: 78362 germ=IGHV1-2*02 seqid1=50.4 seqid3=50.0 thrd1=0.161 thrd3=0.156 divg=0.132 Nucleic acid sequence=SEQ ID NO: 347 Amino acid sequence=SEQ ID NO: 1047; Antibody Heavy Chain No: 83864 germ=IGHV1-2*02 seqid1=53.7 seqid3=47.7 thrd1=0.093 thrd3=0.133 divg=0.132 Nucleic acid sequence=SEQ ID NO: 348 Amino acid sequence=SEQ ID NO: 1048; Antibody Heavy Chain No: 39670 germ=IGHV1-2*02 seqid1=48.8 seqid3=48.5 thrd1=0.161 thrd3=0.156 divg=0.132 Nucleic acid sequence=SEQ ID NO: 349 Amino acid sequence=SEQ ID NO: 1049; Antibody Heavy Chain No: 113372 germ=IGHV1-2*02 seqid1=50.4 seqid3=50.0 thrd1=0.161 thrd3=0.156 divg=0.132 Nucleic acid sequence=SEQ ID NO: 350 Amino acid sequence=SEQ ID NO: 1050; Antibody Heavy Chain No: 55937 germ=IGHV1-2*02 seqid1=50.4 seqid3=50.0 thrd1=0.161 thrd3=0.156 divg=0.132 Nucleic acid sequence=SEQ ID NO: 351 Amino acid sequence=SEQ ID NO: 1051; Antibody Heavy Chain No: 30882 germ=IGHV1-2*02 seqid1=50.4 seqid3=50.0 thrd1=0.161 thrd3=0.156 divg=0.132 Nucleic acid sequence=SEQ ID NO: 352 Amino acid sequence=SEQ ID NO: 1052; Antibody Heavy Chain No: 121824 germ=IGHV1-2*02 seqid1=50.4 seqid3=50.0 thrd1=0.161 thrd3=0.156 divg=0.132 Nucleic acid sequence=SEQ ID NO: 353 Amino acid sequence=SEQ ID NO: 1053; Antibody Heavy Chain No: 36567 germ=IGHV1-2*02 seqid1=50.4 seqid3=50.0 thrd1=0.161 thrd3=0.156 divg=0.132 Nucleic acid sequence=SEQ ID NO: 354 Amino acid sequence=SEQ ID NO: 1054; Antibody Heavy Chain No: 112475 germ=IGHV1-2*02 seqid1=50.4 seqid3=50.0 thrd1=0.161 thrd3=0.156 divg=0.132 Nucleic acid sequence=SEQ ID NO: 355 Amino acid sequence=SEQ ID NO: 1055; Antibody Heavy Chain No: 38636 germ=IGHV1-2*02 seqid1=50.4 seqid3=50.0 thrd1=0.161 thrd3=0.156 divg=0.132 Nucleic acid sequence=SEQ ID NO: 356 Amino acid sequence=SEQ ID NO: 1056; Antibody Heavy Chain No: 47990 germ=IGHV1-2*02 seqid1=50.4 seqid3=50.0 thrd1=0.161 thrd3=0.156 divg=0.132 Nucleic acid sequence=SEQ ID NO: 357 Amino acid sequence=SEQ ID NO: 1057; Antibody Heavy Chain No: 69898 germ=IGHV1-2*02 seqid1=50.4 seqid3=50.0 thrd1=0.161 thrd3=0.156 divg=0.132 Nucleic acid sequence=SEQ ID NO: 358 Amino acid sequence=SEQ ID NO: 1058; Antibody Heavy Chain No: 22432 germ=IGHV1-2*02 seqid1=50.4 seqid3=50.0 thrd1=0.161 thrd3=0.156 divg=0.132 Nucleic acid sequence=SEQ ID NO: 359 Amino acid sequence=SEQ ID NO: 1059; Antibody Heavy Chain No: 51559 germ=IGHV1-2*02 seqid1=50.4 seqid3=50.0 thrd1=0.161 thrd3=0.156 divg=0.132 Nucleic acid sequence=SEQ ID NO: 360 Amino acid sequence=SEQ ID NO: 1060; Antibody Heavy Chain No: 104370 germ=IGHV1-2*02 seqid1=50.4 seqid3=50.0 thrd1=0.161 thrd3=0.156 divg=0.132 Nucleic acid sequence=SEQ ID NO: 361 Amino acid sequence=SEQ ID NO: 1061; Antibody Heavy Chain No: 70186 germ=IGHV1-2*02 seqid1=50.4 seqid3=50.0 thrd1=0.161 thrd3=0.156 divg=0.132 Nucleic acid sequence=SEQ ID NO: 362 Amino acid sequence=SEQ ID NO: 1062; Antibody Heavy Chain No: 66807 germ=IGHV1-2*02 seqid1=50.4 seqid3=50.0 thrd1=0.161 thrd3=0.156 divg=0.132 Nucleic acid sequence=SEQ ID NO: 363 Amino acid sequence=SEQ ID NO: 1063; Antibody Heavy Chain No: 36621 germ=IGHV1-2*02 seqid1=50.4 seqid3=50.0 thrd1=0.161 thrd3=0.156 divg=0.132 Nucleic acid sequence=SEQ ID NO: 364 Amino acid sequence=SEQ ID NO: 1064; Antibody Heavy Chain No: 16321 germ=IGHV1-2*02 seqid1=50.4 seqid3=50.0 thrd1=0.161 thrd3=0.156 divg=0.132 Nucleic acid sequence=SEQ ID NO: 365 Amino acid sequence=SEQ ID NO: 1065; Antibody Heavy Chain No: 50350 germ=IGHV1-2*02 seqid1=50.4 seqid3=50.0 thrd1=0.161 thrd3=0.156 divg=0.132 Nucleic acid sequence=SEQ ID NO: 366 Amino acid sequence=SEQ ID NO: 1066; Antibody Heavy Chain No: 182546 germ=IGHV1-2*02 seqid1=46.3 seqid3=43.1 thrd1=0.179 thrd3=0.143 divg=0.132 Nucleic acid sequence=SEQ ID NO: 367 Amino acid sequence=SEQ ID NO: 1067; Antibody Heavy Chain No: 87519 germ=IGHV1-2*02 seqid1=47.9 seqid3=47.7 thrd1=0.162 thrd3=0.157 divg=0.132 Nucleic acid sequence=SEQ ID NO: 368 Amino acid sequence=SEQ ID NO: 1068; Antibody Heavy Chain No: 38456 germ=IGHV1-2*02 seqid1=50.4 seqid3=50.0 thrd1=0.161 thrd3=0.156 divg=0.132 Nucleic acid sequence=SEQ ID NO: 369 Amino acid sequence=SEQ ID NO: 1069; Antibody Heavy Chain No: 92098 germ=IGHV1-2*02 seqid1=53.7 seqid3=47.7 thrd1=0.093 thrd3=0.133 divg=0.132 Nucleic acid sequence=SEQ ID NO: 370 Amino acid sequence=SEQ ID NO: 1070; Antibody Heavy Chain No: 98786 germ=IGHV1-2*02 seqid1=50.4 seqid3=50.0 thrd1=0.161 thrd3=0.156 divg=0.132 Nucleic acid sequence=SEQ ID NO: 371 Amino acid sequence=SEQ ID NO: 1071; Antibody Heavy Chain No: 79026 germ=IGHV1-2*02 seqid1=49.6 seqid3=50.0 thrd1=0.163 thrd3=0.157 divg=0.132 Nucleic acid sequence=SEQ ID NO: 372 Amino acid sequence=SEQ ID NO: 1072; Antibody Heavy Chain No: 192622 germ=IGHV1-2*02 seqid1=50.4 seqid3=50.0 thrd1=0.161 thrd3=0.156 divg=0.132 Nucleic acid sequence=SEQ ID NO: 373 Amino acid sequence=SEQ ID NO: 1073; Antibody Heavy Chain No: 4423 germ=IGHV1-2*02 seqid1=47.9 seqid3=47.7 thrd1=0.160 thrd3=0.155 divg=0.132 Nucleic acid sequence=SEQ ID NO: 374 Amino acid sequence=SEQ ID NO: 1074; Antibody Heavy Chain No: 39390 germ=IGHV1-2*02 seqid1=50.4 seqid3=50.0 thrd1=0.161 thrd3=0.156 divg=0.132 Nucleic acid sequence=SEQ ID NO: 375 Amino acid sequence=SEQ ID NO: 1075; Antibody Heavy Chain No: 121691 germ=IGHV1-2*02 seqid1=45.5 seqid3=47.7 thrd1=0.181 thrd3=0.183 divg=0.132 Nucleic acid sequence=SEQ ID NO: 376 Amino acid sequence=SEQ ID NO: 1076; Antibody Heavy Chain No: 114705 germ=IGHV1-2*02 seqid1=47.9 seqid3=47.7 thrd1=0.162 thrd3=0.157 divg=0.132 Nucleic acid sequence=SEQ ID NO: 377 Amino acid sequence=SEQ ID NO: 1077; Antibody Heavy Chain No: 66658 germ=IGHV1-2*02 seqid1=50.4 seqid3=50.0 thrd1=0.161 thrd3=0.156 divg=0.132 Nucleic acid sequence=SEQ ID NO: 378 Amino acid sequence=SEQ ID NO: 1078; Antibody Heavy Chain No: 20622 germ=IGHV1-2*02 seqid1=50.4 seqid3=50.0 thrd1=0.161 thrd3=0.156 divg=0.132 Nucleic acid sequence=SEQ ID NO: 379 Amino acid sequence=SEQ ID NO: 1079; Antibody Heavy Chain No: 7790 germ=IGHV1-2*02 seqid1=50.4 seqid3=50.0 thrd1=0.161 thrd3=0.156 divg=0.132 Nucleic acid sequence=SEQ ID NO: 380 Amino acid sequence=SEQ ID NO: 1080; Antibody Heavy Chain No: 74326 germ=IGHV1-2*02 seqid1=53.7 seqid3=47.7 thrd1=0.093 thrd3=0.133 divg=0.132 Nucleic acid sequence=SEQ ID NO: 381 Amino acid sequence=SEQ ID NO: 1081; Antibody Heavy Chain No: 62399 germ=IGHV1-2*02 seqid1=50.4 seqid3=50.0 thrd1=0.161 thrd3=0.156 divg=0.132 Nucleic acid sequence=SEQ ID NO: 382 Amino acid sequence=SEQ ID NO: 1082; Antibody Heavy Chain No: 90523 germ=IGHV1-2*02 seqid1=50.4 seqid3=50.0 thrd1=0.161 thrd3=0.156 divg=0.132 Nucleic acid sequence=SEQ ID NO: 383 Amino acid sequence=SEQ ID NO: 1083; Antibody Heavy Chain No: 86744 germ=IGHV1-2*02 seqid1=52.1 seqid3=46.2 thrd1=0.101 thrd3=0.140 divg=0.132 Nucleic acid sequence=SEQ ID NO: 384 Amino acid sequence=SEQ ID NO: 1084; Antibody Heavy Chain No: 65521 germ=IGHV1-2*02 seqid1=53.7 seqid3=47.7 thrd1=0.093 thrd3=0.133 divg=0.132 Nucleic acid sequence=SEQ ID NO: 385 Amino acid sequence=SEQ ID NO: 1085; Antibody Heavy Chain No: 25587 germ=IGHV1-2*02 seqid1=50.4 seqid3=50.0 thrd1=0.161 thrd3=0.156 divg=0.132 Nucleic acid sequence=SEQ ID NO: 386 Amino acid sequence=SEQ ID NO: 1086; Antibody Heavy Chain No: 93763 germ=IGHV1-2*02 seqid1=50.4 seqid3=50.0 thrd1=0.161 thrd3=0.156 divg=0.132 Nucleic acid sequence=SEQ ID NO: 387 Amino acid sequence=SEQ ID NO: 1087; Antibody Heavy Chain No: 8204 germ=IGHV1-2*02 seqid1=50.4 seqid3=50.0 thrd1=0.161 thrd3=0.156 divg=0.132 Nucleic acid sequence=SEQ ID NO: 388 Amino acid sequence=SEQ ID NO: 1088; Antibody Heavy Chain No: 32439 germ=IGHV1-2*02 seqid1=53.7 seqid3=47.7 thrd1=0.093 thrd3=0.133 divg=0.132 Nucleic acid sequence=SEQ ID NO: 389 Amino acid sequence=SEQ ID NO: 1089; Antibody Heavy Chain No: 29882 germ=IGHV1-2*02 seqid1=50.4 seqid3=50.0 thrd1=0.161 thrd3=0.156 divg=0.132 Nucleic acid sequence=SEQ ID NO: 390 Amino acid sequence=SEQ ID NO: 1090; Antibody Heavy Chain No: 33693 germ=IGHV1-2*02 seqid1=50.4 seqid3=50.0 thrd1=0.161 thrd3=0.156 divg=0.132 Nucleic acid sequence=SEQ ID NO: 391 Amino acid sequence=SEQ ID NO: 1091; Antibody Heavy Chain No: 13076 germ=IGHV1-2*02 seqid1=50.4 seqid3=50.0 thrd1=0.161 thrd3=0.156 divg=0.132 Nucleic acid sequence=SEQ ID NO: 392 Amino acid sequence=SEQ ID NO: 1092; Antibody Heavy Chain No: 31565 germ=IGHV1-2*02 seqid1=50.4 seqid3=50.0 thrd1=0.161 thrd3=0.156 divg=0.132 Nucleic acid sequence=SEQ ID NO: 393 Amino acid sequence=SEQ ID NO: 1093; Antibody Heavy Chain No: 114518 germ=IGHV1-2*02 seqid1=50.4 seqid3=50.0 thrd1=0.161 thrd3=0.156 divg=0.132 Nucleic acid sequence=SEQ ID NO: 394 Amino acid sequence=SEQ ID NO: 1094; Antibody Heavy Chain No: 55150 germ=IGHV1-2*02 seqid1=39.7 seqid3=40.8 thrd1=0.204 thrd3=0.313 divg=0.132 Nucleic acid sequence=SEQ ID NO: 395 Amino acid sequence=SEQ ID NO: 1095; Antibody Heavy Chain No: 83555 germ=IGHV1-2*02 seqid1=47.9 seqid3=47.7 thrd1=0.162 thrd3=0.157 divg=0.132 Nucleic acid sequence=SEQ ID NO: 396 Amino acid sequence=SEQ ID NO: 1096; Antibody Heavy Chain No: 57699 germ=IGHV1-2*02 seqid1=52.9 seqid3=46.9 thrd1=0.192 thrd3=0.214 divg=0.132 Nucleic acid sequence=SEQ ID NO: 397 Amino acid sequence=SEQ ID NO: 1097; Antibody Heavy Chain No: 46426 germ=IGHV1-2*02 seqid1=50.4 seqid3=50.0 thrd1=0.161 thrd3=0.156 divg=0.132 Nucleic acid sequence=SEQ ID NO: 398 Amino acid sequence=SEQ ID NO: 1098; Antibody Heavy Chain No: 50130 germ=IGHV1-2*02 seqid1=50.4 seqid3=50.0 thrd1=0.161 thrd3=0.156 divg=0.132 Nucleic acid sequence=SEQ ID NO: 399 Amino acid sequence=SEQ ID NO: 1099; Antibody Heavy Chain No: 17965 germ=IGHV1-2*02 seqid1=50.4 seqid3=50.0 thrd1=0.161 thrd3=0.156 divg=0.132 Nucleic acid sequence=SEQ ID NO: 400 Amino acid sequence=SEQ ID NO: 1100; Antibody Heavy Chain No: 40699 germ=IGHV1-2*02 seqid1=50.4 seqid3=50.0 thrd1=0.161 thrd3=0.156 divg=0.132 Nucleic acid sequence=SEQ ID NO: 401 Amino acid sequence=SEQ ID NO: 1101; Antibody Heavy Chain No: 17552 germ=IGHV1-2*02 seqid1=50.4 seqid3=50.0 thrd1=0.161 thrd3=0.156 divg=0.132 Nucleic acid sequence=SEQ ID NO: 402 Amino acid sequence=SEQ ID NO: 1102; Antibody Heavy Chain No: 73425 germ=IGHV1-2*02 seqid1=50.4 seqid3=50.0 thrd1=0.161 thrd3=0.156 divg=0.132 Nucleic acid sequence=SEQ ID NO: 403 Amino acid sequence=SEQ ID NO: 1103; Antibody Heavy Chain No: 20437 germ=IGHV1-2*02 seqid1=53.7 seqid3=47.7 thrd1=0.093 thrd3=0.133 divg=0.132 Nucleic acid sequence=SEQ ID NO: 404 Amino acid sequence=SEQ ID NO: 1104; Antibody Heavy Chain No: 59091 germ=IGHV1-2*02 seqid1=49.6 seqid3=49.2 thrd1=0.158 thrd3=0.154 divg=0.132 Nucleic acid sequence=SEQ ID NO: 405 Amino acid sequence=SEQ ID NO: 1105; Antibody Heavy Chain No: 21770 germ=IGHV1-2*02 seqid1=53.7 seqid3=47.7 thrd1=0.093 thrd3=0.133 divg=0.132 Nucleic acid sequence=SEQ ID NO: 406 Amino acid sequence=SEQ ID NO: 1106; Antibody Heavy Chain No: 11760 germ=IGHV1-2*02 seqid1=50.4 seqid3=50.0 thrd1=0.161 thrd3=0.156 divg=0.132 Nucleic acid sequence=SEQ ID NO: 407 Amino acid sequence=SEQ ID NO: 1107; Antibody Heavy Chain No: 92232 germ=IGHV1-2*02 seqid1=50.4 seqid3=50.0 thrd1=0.161 thrd3=0.156 divg=0.132 Nucleic acid sequence=SEQ ID NO: 408 Amino acid sequence=SEQ ID NO: 1108; Antibody Heavy Chain No: 77905 germ=IGHV1-2*02 seqid1=50.4 seqid3=50.0 thrd1=0.161 thrd3=0.156 divg=0.132 Nucleic acid sequence=SEQ ID NO: 409 Amino acid sequence=SEQ ID NO: 1109; Antibody Heavy Chain No: 114286 germ=IGHV1-2*02 seqid1=50.4 seqid3=50.0 thrd1=0.161 thrd3=0.156 divg=0.132 Nucleic acid sequence=SEQ ID NO: 410 Amino acid sequence=SEQ ID NO: 1110; Antibody Heavy Chain No: 17493 germ=IGHV1-2*02 seqid1=53.7 seqid3=47.7 thrd1=0.093 thrd3=0.133 divg=0.132 Nucleic acid sequence=SEQ ID NO: 411 Amino acid sequence=SEQ ID NO: 1111; Antibody Heavy Chain No: 134356 germ=IGHV1-2*02 seqid1=50.4 seqid3=50.0 thrd1=0.161 thrd3=0.156 divg=0.132 Nucleic acid sequence=SEQ ID NO: 412 Amino acid sequence=SEQ ID NO: 1112; Antibody Heavy Chain No: 55840 germ=IGHV1-2*02 seqid1=53.7 seqid3=47.7 thrd1=0.093 thrd3=0.133 divg=0.128 Nucleic acid sequence=SEQ ID NO: 413 Amino acid sequence=SEQ ID NO: 1113; Antibody Heavy Chain No: 20575 germ=IGHV1-2*02 seqid1=43.8 seqid3=45.4 thrd1=0.253 thrd3=0.185 divg=0.128 Nucleic acid sequence=SEQ ID NO: 414 Amino acid sequence=SEQ ID NO: 1114; Antibody Heavy Chain No: 31418 germ=IGHV1-2*02 seqid1=53.7 seqid3=47.7 thrd1=0.093 thrd3=0.133 divg=0.128 Nucleic acid sequence=SEQ ID NO: 415 Amino acid sequence=SEQ ID NO: 1115; Antibody Heavy Chain No: 25111 germ=IGHV1-2*02 seqid1=53.7 seqid3=47.7 thrd1=0.093 thrd3=0.133 divg=0.128 Nucleic acid sequence=SEQ ID NO: 416 Amino acid sequence=SEQ ID NO: 1116; Antibody Heavy Chain No: 6508 germ=IGHV1-2*02 seqid1=53.7 seqid3=47.7 thrd1=0.093 thrd3=0.133 divg=0.128 Nucleic acid sequence=SEQ ID NO: 417 Amino acid sequence=SEQ ID NO: 1117; Antibody Heavy Chain No: 34999 germ=IGHV1-2*02 seqid1=53.7 seqid3=47.7 thrd1=0.093 thrd3=0.133 divg=0.128 Nucleic acid sequence=SEQ ID NO: 418 Amino acid sequence=SEQ ID NO: 1118; Antibody Heavy Chain No: 46977 germ=IGHV1-2*02 seqid1=53.7 seqid3=47.7 thrd1=0.093 thrd3=0.133 divg=0.128 Nucleic acid sequence=SEQ ID NO: 419 Amino acid sequence=SEQ ID NO: 1119; Antibody Heavy Chain No: 16971 germ=IGHV1-2*02 seqid1=50.4 seqid3=50.0 thrd1=0.161 thrd3=0.156 divg=0.128 Nucleic acid sequence=SEQ ID NO: 420 Amino acid sequence=SEQ ID NO: 1120; Antibody Heavy Chain No: 42695 germ=IGHV1-2*02 seqid1=52.1 seqid3=47.7 thrd1=0.187 thrd3=0.130 divg=0.128 Nucleic acid sequence=SEQ ID NO: 421 Amino acid sequence=SEQ ID NO: 1121; Antibody Heavy Chain No: 40345 germ=IGHV1-2*02 seqid1=53.7 seqid3=47.7 thrd1=0.093 thrd3=0.133 divg=0.128 Nucleic acid sequence=SEQ ID NO: 422 Amino acid sequence=SEQ ID NO: 1122; Antibody Heavy Chain No: 12622 germ=IGHV1-2*02 seqid1=53.7 seqid3=47.7 thrd1=0.093 thrd3=0.133 divg=0.128 Nucleic acid sequence=SEQ ID NO: 423 Amino acid sequence=SEQ ID NO: 1123; Antibody Heavy Chain No: 17063 germ=IGHV1-2*02 seqid1=51.2 seqid3=50.8 thrd1=0.172 thrd3=0.145 divg=0.128 Nucleic acid sequence=SEQ ID NO: 424 Amino acid sequence=SEQ ID NO: 1124; Antibody Heavy Chain No: 49945 germ=IGHV1-2*02 seqid1=50.4 seqid3=44.6 thrd1=0.105 thrd3=0.149 divg=0.128 Nucleic acid sequence=SEQ ID NO: 425 Amino acid sequence=SEQ ID NO: 1125; Antibody Heavy Chain No: 47052 germ=IGHV1-2*02 seqid1=52.9 seqid3=49.2 thrd1=0.117 thrd3=0.117 divg=0.128 Nucleic acid sequence=SEQ ID NO: 426 Amino acid sequence=SEQ ID NO: 1126; Antibody Heavy Chain No: 63586 germ=IGHV1-2*02 seqid1=53.7 seqid3=47.7 thrd1=0.093 thrd3=0.133 divg=0.128 Nucleic acid sequence=SEQ ID NO: 427 Amino acid sequence=SEQ ID NO: 1127; Antibody Heavy Chain No: 92372 germ=IGHV1-2*02 seqid1=52.9 seqid3=50.0 thrd1=0.170 thrd3=0.157 divg=0.128 Nucleic acid sequence=SEQ ID NO: 428 Amino acid sequence=SEQ ID NO: 1128; Antibody Heavy Chain No: 31043 germ=IGHV1-2*02 seqid1=53.7 seqid3=47.7 thrd1=0.093 thrd3=0.133 divg=0.128 Nucleic acid sequence=SEQ ID NO: 429 Amino acid sequence=SEQ ID NO: 1129; Antibody Heavy Chain No: 10325 germ=IGHV1-2*02 seqid1=50.4 seqid3=50.0 thrd1=0.161 thrd3=0.156 divg=0.128 Nucleic acid sequence=SEQ ID NO: 430 Amino acid sequence=SEQ ID NO: 1130; Antibody Heavy Chain No: 34950 germ=IGHV1-2*02 seqid1=53.7 seqid3=47.7 thrd1=0.093 thrd3=0.133 divg=0.128 Nucleic acid sequence=SEQ ID NO: 431 Amino acid sequence=SEQ ID NO: 1131; Antibody Heavy Chain No: 31131 germ=IGHV1-2*02 seqid1=53.7 seqid3=47.7 thrd1=0.093 thrd3=0.133 divg=0.128 Nucleic acid sequence=SEQ ID NO: 432 Amino acid sequence=SEQ ID NO: 1132; Antibody Heavy Chain No: 35353 germ=IGHV1-2*02 seqid1=53.7 seqid3=47.7 thrd1=0.093 thrd3=0.133 divg=0.128 Nucleic acid sequence=SEQ ID NO: 433 Amino acid sequence=SEQ ID NO: 1133; Antibody Heavy Chain No: 46948 germ=IGHV1-2*02 seqid1=53.7 seqid3=47.7 thrd1=0.093 thrd3=0.133 divg=0.128 Nucleic acid sequence=SEQ ID NO: 434 Amino acid sequence=SEQ ID NO: 1134; Antibody Heavy Chain No: 65582 germ=IGHV1-2*02 seqid1=50.4 seqid3=50.0 thrd1=0.161 thrd3=0.156 divg=0.128 Nucleic acid sequence=SEQ ID NO: 435 Amino acid sequence=SEQ ID NO: 1135; Antibody Heavy Chain No: 79430 germ=IGHV1-2*02 seqid1=53.7 seqid3=47.7 thrd1=0.093 thrd3=0.133 divg=0.128 Nucleic acid sequence=SEQ ID NO: 436 Amino acid sequence=SEQ ID NO: 1136; Antibody Heavy Chain No: 35657 germ=IGHV1-2*02 seqid1=50.4 seqid3=46.9 thrd1=0.162 thrd3=0.185 divg=0.128 Nucleic acid sequence=SEQ ID NO: 437 Amino acid sequence=SEQ ID NO: 1137; Antibody Heavy Chain No: 60213 germ=IGHV1-2*02 seqid1=53.7 seqid3=47.7 thrd1=0.093 thrd3=0.133 divg=0.128 Nucleic acid sequence=SEQ ID NO: 438 Amino acid sequence=SEQ ID NO: 1138; Antibody Heavy Chain No: 114115 germ=IGHV1-2*02 seqid1=53.7 seqid3=47.7 thrd1=0.093 thrd3=0.133 divg=0.128 Nucleic acid sequence=SEQ ID NO: 439 Amino acid sequence=SEQ ID NO: 1139; Antibody Heavy Chain No: 33812 germ=IGHV1-2*02 seqid1=53.7 seqid3=47.7 thrd1=0.093 thrd3=0.133 divg=0.128 Nucleic acid sequence=SEQ ID NO: 440 Amino acid sequence=SEQ ID NO: 1140; Antibody Heavy Chain No: 8579 germ=IGHV1-2*02 seqid1=53.7 seqid3=47.7 thrd1=0.093 thrd3=0.133 divg=0.128 Nucleic acid sequence=SEQ ID NO: 441 Amino acid sequence=SEQ ID NO: 1141; Antibody Heavy Chain No: 139116 germ=IGHV1-2*02 seqid1=53.7 seqid3=47.7 thrd1=0.093 thrd3=0.133 divg=0.128 Nucleic acid sequence=SEQ ID NO: 442 Amino acid sequence=SEQ ID NO: 1142; Antibody Heavy Chain No: 22596 germ=IGHV1-2*02 seqid1=53.7 seqid3=47.7 thrd1=0.093 thrd3=0.133 divg=0.128 Nucleic acid sequence=SEQ ID NO: 443 Amino acid sequence=SEQ ID NO: 1143; Antibody Heavy Chain No: 34400 germ=IGHV1-2*02 seqid1=50.4 seqid3=50.0 thrd1=0.161 thrd3=0.156 divg=0.128 Nucleic acid sequence=SEQ ID NO: 444 Amino acid sequence=SEQ ID NO: 1144; Antibody Heavy Chain No: 115582 germ=IGHV1-2*02 seqid1=52.1 seqid3=47.7 thrd1=0.187 thrd3=0.130 divg=0.128 Nucleic acid sequence=SEQ ID NO: 445 Amino acid sequence=SEQ ID NO: 1145; Antibody Heavy Chain No: 53897 germ=IGHV1-2*02 seqid1=53.7 seqid3=47.7 thrd1=0.093 thrd3=0.133 divg=0.128 Nucleic acid sequence=SEQ ID NO: 446 Amino acid sequence=SEQ ID NO: 1146; Antibody Heavy Chain No: 18972 germ=IGHV1-2*02 seqid1=53.7 seqid3=47.7 thrd1=0.093 thrd3=0.133 divg=0.128 Nucleic acid sequence=SEQ ID NO: 447 Amino acid sequence=SEQ ID NO: 1147; Antibody Heavy Chain No: 38620 germ=IGHV1-2*02 seqid1=51.2 seqid3=50.0 thrd1=0.160 thrd3=0.155 divg=0.128 Nucleic acid sequence=SEQ ID NO: 448 Amino acid sequence=SEQ ID NO: 1148; Antibody Heavy Chain No: 109187 germ=IGHV1-2*02 seqid1=53.7 seqid3=47.7 thrd1=0.093 thrd3=0.133 divg=0.128 Nucleic acid sequence=SEQ ID NO: 449 Amino acid sequence=SEQ ID NO: 1149; Antibody Heavy Chain No: 14179 germ=IGHV1-2*02 seqid1=51.2 seqid3=50.0 thrd1=0.160 thrd3=0.155 divg=0.128 Nucleic acid sequence=SEQ ID NO: 450 Amino acid sequence=SEQ ID NO: 1150; Antibody Heavy Chain No: 66584 germ=IGHV1-2*02 seqid1=53.7 seqid3=47.7 thrd1=0.093 thrd3=0.133 divg=0.128 Nucleic acid sequence=SEQ ID NO: 451 Amino acid sequence=SEQ ID NO: 1151; Antibody Heavy Chain No: 7295 germ=IGHV1-2*02 seqid1=49.6 seqid3=51.5 thrd1=0.154 thrd3=0.196 divg=0.128 Nucleic acid sequence=SEQ ID NO: 452 Amino acid sequence=SEQ ID NO: 1152; Antibody Heavy Chain No: 82463 germ=IGHV1-2*02 seqid1=54.5 seqid3=50.8 thrd1=0.150 thrd3=0.120 divg=0.128 Nucleic acid sequence=SEQ ID NO: 453 Amino acid sequence=SEQ ID NO: 1153; Antibody Heavy Chain No: 142429 germ=IGHV1-2*02 seqid1=53.7 seqid3=46.2 thrd1=0.100 thrd3=0.138 divg=0.128 Nucleic acid sequence=SEQ ID NO: 454 Amino acid sequence=SEQ ID NO: 1154; Antibody Heavy Chain No: 39408 germ=IGHV1-2*02 seqid1=44.6 seqid3=46.2 thrd1=0.218 thrd3=0.168 divg=0.125 Nucleic acid sequence=SEQ ID NO: 455 Amino acid sequence=SEQ ID NO: 1155; Antibody Heavy Chain No: 71215 germ=IGHV1-2*02 seqid1=43.8 seqid3=45.4 thrd1=0.219 thrd3=0.167 divg=0.125 Nucleic acid sequence=SEQ ID NO: 456 Amino acid sequence=SEQ ID NO: 1156; Antibody Heavy Chain No: 9788 germ=IGHV1-2*02 seqid1=49.6 seqid3=46.2 thrd1=0.188 thrd3=0.174 divg=0.125 Nucleic acid sequence=SEQ ID NO: 457 Amino acid sequence=SEQ ID NO: 1157; Antibody Heavy Chain No: 37061 germ=IGHV1-2*02 seqid1=51.2 seqid3=50.8 thrd1=0.172 thrd3=0.226 divg=0.125 Nucleic acid sequence=SEQ ID NO: 458 Amino acid sequence=SEQ ID NO: 1158; Antibody Heavy Chain No: 115015 germ=IGHV1-2*02 seqid1=53.7 seqid3=50.8 thrd1=0.147 thrd3=0.131 divg=0.125 Nucleic acid sequence=SEQ ID NO: 459 Amino acid sequence=SEQ ID NO: 1159; Antibody Heavy Chain No: 46793 germ=IGHV1-2*02 seqid1=44.6 seqid3=46.2 thrd1=0.247 thrd3=0.168 divg=0.125 Nucleic acid sequence=SEQ ID NO: 460 Amino acid sequence=SEQ ID NO: 1160; Antibody Heavy Chain No: 80516 germ=IGHV1-2*02 seqid1=47.1 seqid3=45.4 thrd1=0.187 thrd3=0.204 divg=0.125 Nucleic acid sequence=SEQ ID NO: 461 Amino acid sequence=SEQ ID NO: 1161; Antibody Heavy Chain No: 76415 germ=IGHV1-2*02 seqid1=49.6 seqid3=47.7 thrd1=0.196 thrd3=0.218 divg=0.125 Nucleic acid sequence=SEQ ID NO: 462 Amino acid sequence=SEQ ID NO: 1162; Antibody Heavy Chain No: 154569 germ=IGHV1-2*02 seqid1=47.9 seqid3=49.2 thrd1=0.206 thrd3=0.150 divg=0.125 Nucleic acid sequence=SEQ ID NO: 463 Amino acid sequence=SEQ ID NO: 1163; Antibody Heavy Chain No: 104939 germ=IGHV1-2*02 seqid1=52.1 seqid3=53.8 thrd1=0.176 thrd3=0.128 divg=0.122 Nucleic acid sequence=SEQ ID NO: 464 Amino acid sequence=SEQ ID NO: 1164; Antibody Heavy Chain No: 92580 germ=IGHV1-2*02 seqid1=49.6 seqid3=48.5 thrd1=0.190 thrd3=0.147 divg=0.122 Nucleic acid sequence=SEQ ID NO: 465 Amino acid sequence=SEQ ID NO: 1165; Antibody Heavy Chain No: 30625 germ=IGHV1-2*02 seqid1=53.7 seqid3=50.0 thrd1=0.146 thrd3=0.132 divg=0.122 Nucleic acid sequence=SEQ ID NO: 466 Amino acid sequence=SEQ ID NO: 1166; Antibody Heavy Chain No: 91867 germ=IGHV1-2*02 seqid1=51.2 seqid3=47.7 thrd1=0.225 thrd3=0.156 divg=0.122 Nucleic acid sequence=SEQ ID NO: 467 Amino acid sequence=SEQ ID NO: 1167; Antibody Heavy Chain No: 62307 germ=IGHV1-2*02 seqid1=48.8 seqid3=47.7 thrd1=0.172 thrd3=0.164 divg=0.122 Nucleic acid sequence=SEQ ID NO: 468 Amino acid sequence=SEQ ID NO: 1168; Antibody Heavy Chain No: 26484 germ=IGHV1-2*02 seqid1=54.5 seqid3=47.7 thrd1=0.183 thrd3=0.154 divg=0.122 Nucleic acid sequence=SEQ ID NO: 469 Amino acid sequence=SEQ ID NO: 1169; Antibody Heavy Chain No: 40754 germ=IGHV1-2*02 seqid1=52.1 seqid3=50.8 thrd1=0.163 thrd3=0.159 divg=0.122 Nucleic acid sequence=SEQ ID NO: 470 Amino acid sequence=SEQ ID NO: 1170; Antibody Heavy Chain No: 151057 germ=IGHV1-2*02 seqid1=50.4 seqid3=52.3 thrd1=0.152 thrd3=0.191 divg=0.122 Nucleic acid sequence=SEQ ID NO: 471 Amino acid sequence=SEQ ID NO: 1171; Antibody Heavy Chain No: 51285 germ=IGHV1-2*02 seqid1=53.7 seqid3=44.6 thrd1=0.204 thrd3=0.155 divg=0.122 Nucleic acid sequence=SEQ ID NO: 472 Amino acid sequence=SEQ ID NO: 1172; Antibody Heavy Chain No: 23038 germ=IGHV1-2*02 seqid1=52.1 seqid3=50.0 thrd1=0.147 thrd3=0.135 divg=0.122 Nucleic acid sequence=SEQ ID NO: 473 Amino acid sequence=SEQ ID NO: 1173; Antibody Heavy Chain No: 118516 germ=IGHV1-2*02 seqid1=53.7 seqid3=50.8 thrd1=0.158 thrd3=0.114 divg=0.122 Nucleic acid sequence=SEQ ID NO: 474 Amino acid sequence=SEQ ID NO: 1174; Antibody Heavy Chain No: 54561 germ=IGHV1-2*02 seqid1=51.2 seqid3=50.0 thrd1=0.173 thrd3=0.165 divg=0.122 Nucleic acid sequence=SEQ ID NO: 475 Amino acid sequence=SEQ ID NO: 1175; Antibody Heavy Chain No: 7907 germ=IGHV1-2*02 seqid1=47.1 seqid3=48.5 thrd1=0.216 thrd3=0.163 divg=0.122 Nucleic acid sequence=SEQ ID NO: 476 Amino acid sequence=SEQ ID NO: 1176; Antibody Heavy Chain No: 48955 germ=IGHV1-2*02 seqid1=52.9 seqid3=44.6 thrd1=0.208 thrd3=0.161 divg=0.122 Nucleic acid sequence=SEQ ID NO: 477 Amino acid sequence=SEQ ID NO: 1177; Antibody Heavy Chain No: 124460 germ=IGHV1-2*02 seqid1=45.5 seqid3=46.9 thrd1=0.216 thrd3=0.165 divg=0.118 Nucleic acid sequence=SEQ ID NO: 478 Amino acid sequence=SEQ ID NO: 1178; Antibody Heavy Chain No: 60838 germ=IGHV1-2*02 seqid1=45.5 seqid3=45.4 thrd1=0.188 thrd3=0.145 divg=0.118 Nucleic acid sequence=SEQ ID NO: 479 Amino acid sequence=SEQ ID NO: 1179; Antibody Heavy Chain No: 9327 germ=IGHV1-2*02 seqid1=54.5 seqid3=50.8 thrd1=0.136 thrd3=0.112 divg=0.118 Nucleic acid sequence=SEQ ID NO: 480 Amino acid sequence=SEQ ID NO: 1180; Antibody Heavy Chain No: 12603 germ=IGHV1-2*02 seqid1=44.6 seqid3=46.2 thrd1=0.218 thrd3=0.168 divg=0.118 Nucleic acid sequence=SEQ ID NO: 481 Amino acid sequence=SEQ ID NO: 1181; Antibody Heavy Chain No: 67294 germ=IGHV1-2*02 seqid1=41.3 seqid3=43.8 thrd1=0.199 thrd3=0.390 divg=0.118 Nucleic acid sequence=SEQ ID NO: 482 Amino acid sequence=SEQ ID NO: 1182; Antibody Heavy Chain No: 31882 germ=IGHV1-2*02 seqid1=43.8 seqid3=45.4 thrd1=0.212 thrd3=0.160 divg=0.118 Nucleic acid sequence=SEQ ID NO: 483 Amino acid sequence=SEQ ID NO: 1183; Antibody Heavy Chain No: 7187 germ=IGHV1-2*02 seqid1=47.1 seqid3=48.5 thrd1=0.216 thrd3=0.163 divg=0.118 Nucleic acid sequence=SEQ ID NO: 484 Amino acid sequence=SEQ ID NO: 1184; Antibody Heavy Chain No: 11340 germ=IGHV1-2*02 seqid1=48.8 seqid3=47.7 thrd1=0.150 thrd3=0.118 divg=0.118 Nucleic acid sequence=SEQ ID NO: 485 Amino acid sequence=SEQ ID NO: 1185; Antibody Heavy Chain No: 21889 germ=IGHV1-2*02 seqid1=54.5 seqid3=50.0 thrd1=0.153 thrd3=0.108 divg=0.118 Nucleic acid sequence=SEQ ID NO: 486 Amino acid sequence=SEQ ID NO: 1186; Antibody Heavy Chain No: 48803 germ=IGHV1-2*02 seqid1=53.7 seqid3=50.8 thrd1=0.158 thrd3=0.114 divg=0.118 Nucleic acid sequence=SEQ ID NO: 487 Amino acid sequence=SEQ ID NO: 1187; Antibody Heavy Chain No: 26563 germ=IGHV1-2*02 seqid1=43.8 seqid3=45.4 thrd1=0.212 thrd3=0.160 divg=0.118 Nucleic acid sequence=SEQ ID NO: 488 Amino acid sequence=SEQ ID NO: 1188; Antibody Heavy Chain No: 5049 germ=IGHV1-2*02 seqid1=54.5 seqid3=50.8 thrd1=0.153 thrd3=0.111 divg=0.118 Nucleic acid sequence=SEQ ID NO: 489 Amino acid sequence=SEQ ID NO: 1189; Antibody Heavy Chain No: 52934 germ=IGHV1-2*02 seqid1=52.9 seqid3=48.5 thrd1=0.207 thrd3=0.173 divg=0.118 Nucleic acid sequence=SEQ ID NO: 490 Amino acid sequence=SEQ ID NO: 1190; Antibody Heavy Chain No: 131623 germ=IGHV1-2*02 seqid1=46.3 seqid3=48.5 thrd1=0.217 thrd3=0.163 divg=0.118 Nucleic acid sequence=SEQ ID NO: 491 Amino acid sequence=SEQ ID NO: 1191; Antibody Heavy Chain No: 32431 germ=IGHV1-2*02 seqid1=48.8 seqid3=44.6 thrd1=0.198 thrd3=0.144 divg=0.118 Nucleic acid sequence=SEQ ID NO: 492 Amino acid sequence=SEQ ID NO: 1192; Antibody Heavy Chain No: 49222 germ=IGHV1-2*02 seqid1=52.9 seqid3=49.2 thrd1=0.156 thrd3=0.168 divg=0.118 Nucleic acid sequence=SEQ ID NO: 493 Amino acid sequence=SEQ ID NO: 1193; Antibody Heavy Chain No: 7766 germ=IGHV1-2*02 seqid1=47.1 seqid3=48.5 thrd1=0.214 thrd3=0.161 divg=0.118 Nucleic acid sequence=SEQ ID NO: 494 Amino acid sequence=SEQ ID NO: 1194; Antibody Heavy Chain No: 111944 germ=IGHV1-2*02 seqid1=44.6 seqid3=46.2 thrd1=0.247 thrd3=0.168 divg=0.118 Nucleic acid sequence=SEQ ID NO: 495 Amino acid sequence=SEQ ID NO: 1195; Antibody Heavy Chain No: 42112 germ=IGHV1-2*02 seqid1=47.9 seqid3=49.2 thrd1=0.167 thrd3=0.208 divg=0.118 Nucleic acid sequence=SEQ ID NO: 496 Amino acid sequence=SEQ ID NO: 1196; Antibody Heavy Chain No: 130294 germ=IGHV1-2*02 seqid1=49.6 seqid3=48.5 thrd1=0.149 thrd3=0.117 divg=0.115 Nucleic acid sequence=SEQ ID NO: 497 Amino acid sequence=SEQ ID NO: 1197; Antibody Heavy Chain No: 8818 germ=IGHV1-2*02 seqid1=48.8 seqid3=45.4 thrd1=0.193 thrd3=0.143 divg=0.115 Nucleic acid sequence=SEQ ID NO: 498 Amino acid sequence=SEQ ID NO: 1198; Antibody Heavy Chain No: 84071 germ=IGHV1-2*02 seqid1=49.6 seqid3=50.8 thrd1=0.165 thrd3=0.215 divg=0.115 Nucleic acid sequence=SEQ ID NO: 499 Amino acid sequence=SEQ ID NO: 1199; Antibody Heavy Chain No: 25068 germ=IGHV1-2*02 seqid1=53.7 seqid3=50.8 thrd1=0.158 thrd3=0.114 divg=0.115 Nucleic acid sequence=SEQ ID NO: 500 Amino acid sequence=SEQ ID NO: 1200; Antibody Heavy Chain No: 2768 germ=IGHV1-2*02 seqid1=46.3 seqid3=43.1 thrd1=0.187 thrd3=0.305 divg=0.115 Nucleic acid sequence=SEQ ID NO: 501 Amino acid sequence=SEQ ID NO: 1201; Antibody Heavy Chain No: 16010 germ=IGHV1-2*02 seqid1=52.9 seqid3=50.0 thrd1=0.150 thrd3=0.166 divg=0.115 Nucleic acid sequence=SEQ ID NO: 502 Amino acid sequence=SEQ ID NO: 1202; Antibody Heavy Chain No: 60573 germ=IGHV1-2*02 seqid1=48.8 seqid3=48.5 thrd1=0.181 thrd3=0.151 divg=0.115 Nucleic acid sequence=SEQ ID NO: 503 Amino acid sequence=SEQ ID NO: 1203; Antibody Heavy Chain No: 75010 germ=IGHV1-2*02 seqid1=49.6 seqid3=50.8 thrd1=0.165 thrd3=0.215 divg=0.115 Nucleic acid sequence=SEQ ID NO: 504 Amino acid sequence=SEQ ID NO: 1204; Antibody Heavy Chain No: 56346 germ=IGHV1-2*02 seqid1=52.9 seqid3=50.0 thrd1=0.150 thrd3=0.166 divg=0.115 Nucleic acid sequence=SEQ ID NO: 505 Amino acid sequence=SEQ ID NO: 1205; Antibody Heavy Chain No: 15961 germ=IGHV1-2*02 seqid1=49.6 seqid3=51.5 thrd1=0.164 thrd3=0.202 divg=0.115 Nucleic acid sequence=SEQ ID NO: 506 Amino acid sequence=SEQ ID NO: 1206; Antibody Heavy Chain No: 6826 germ=IGHV1-2*02 seqid1=51.2 seqid3=52.3 thrd1=0.185 thrd3=0.160 divg=0.115 Nucleic acid sequence=SEQ ID NO: 507 Amino acid sequence=SEQ ID NO: 1207; Antibody Heavy Chain No: 64926 germ=IGHV1-2*02 seqid1=49.6 seqid3=50.8 thrd1=0.165 thrd3=0.215 divg=0.115 Nucleic acid sequence=SEQ ID NO: 508 Amino acid sequence=SEQ ID NO: 1208; Antibody Heavy Chain No: 79151 germ=IGHV1-2*02 seqid1=46.3 seqid3=46.2 thrd1=0.183 thrd3=0.146 divg=0.115 Nucleic acid sequence=SEQ ID NO: 509 Amino acid sequence=SEQ ID NO: 1209; Antibody Heavy Chain No: 30800 germ=IGHV1-2*02 seqid1=53.7 seqid3=50.0 thrd1=0.155 thrd3=0.108 divg=0.115 Nucleic acid sequence=SEQ ID NO: 510 Amino acid sequence=SEQ ID NO: 1210; Antibody Heavy Chain No: 77050 germ=IGHV1-2*02 seqid1=50.4 seqid3=49.2 thrd1=0.175 thrd3=0.188 divg=0.115 Nucleic acid sequence=SEQ ID NO: 511 Amino acid sequence=SEQ ID NO: 1211; Antibody Heavy Chain No: 26431 germ=IGHV1-2*02 seqid1=46.3 seqid3=46.2 thrd1=0.187 thrd3=0.143 divg=0.115 Nucleic acid sequence=SEQ ID NO: 512 Amino acid sequence=SEQ ID NO: 1212; Antibody Heavy Chain No: 138734 germ=IGHV1-2*02 seqid1=45.5 seqid3=37.7 thrd1=0.220 thrd3=0.247 divg=0.115 Nucleic acid sequence=SEQ ID NO: 513 Amino acid sequence=SEQ ID NO: 1213; Antibody Heavy Chain No: 25677 germ=IGHV1-2*02 seqid1=50.4 seqid3=48.5 thrd1=0.122 thrd3=0.137 divg=0.115 Nucleic acid sequence=SEQ ID NO: 514 Amino acid sequence=SEQ ID NO: 1214; Antibody Heavy Chain No: 11877 germ=IGHV1-2*02 seqid1=53.7 seqid3=50.8 thrd1=0.158 thrd3=0.114 divg=0.115 Nucleic acid sequence=SEQ ID NO: 515 Amino acid sequence=SEQ ID NO: 1215; Antibody Heavy Chain No: 24914 germ=IGHV1-2*02 seqid1=48.8 seqid3=48.5 thrd1=0.191 thrd3=0.163 divg=0.111 Nucleic acid sequence=SEQ ID NO: 516 Amino acid sequence=SEQ ID NO: 1216; Antibody Heavy Chain No: 66930 germ=IGHV1-2*02 seqid1=44.6 seqid3=43.8 thrd1=0.218 thrd3=0.191 divg=0.111 Nucleic acid sequence=SEQ ID NO: 517 Amino acid sequence=SEQ ID NO: 1217; Antibody Heavy Chain No: 120736 germ=IGHV1-2*02 seqid1=51.2 seqid3=48.5 thrd1=0.158 thrd3=0.206 divg=0.111 Nucleic acid sequence=SEQ ID NO: 518 Amino acid sequence=SEQ ID NO: 1218; Antibody Heavy Chain No: 74892 germ=IGHV1-2*02 seqid1=51.2 seqid3=52.3 thrd1=0.184 thrd3=0.161 divg=0.111 Nucleic acid sequence=SEQ ID NO: 519 Amino acid sequence=SEQ ID NO: 1219; Antibody Heavy Chain No: 62366 germ=IGHV1-2*02 seqid1=52.1 seqid3=50.0 thrd1=0.183 thrd3=0.196 divg=0.111 Nucleic acid sequence=SEQ ID NO: 520 Amino acid sequence=SEQ ID NO: 1220; Antibody Heavy Chain No: 2779 germ=IGHV1-2*02 seqid1=51.2 seqid3=49.2 thrd1=0.176 thrd3=0.168 divg=0.111 Nucleic acid sequence=SEQ ID NO: 521 Amino acid sequence=SEQ ID NO: 1221; Antibody Heavy Chain No: 79804 germ=IGHV1-2*02 seqid1=50.4 seqid3=51.5 thrd1=0.197 thrd3=0.167 divg=0.111 Nucleic acid sequence=SEQ ID NO: 522 Amino acid sequence=SEQ ID NO: 1222; Antibody Heavy Chain No: 26006 germ=IGHV1-2*02 seqid1=51.2 seqid3=52.3 thrd1=0.184 thrd3=0.161 divg=0.111 Nucleic acid sequence=SEQ ID NO: 523 Amino acid sequence=SEQ ID NO: 1223; Antibody Heavy Chain No: 35261 germ=IGHV1-2*02 seqid1=52.1 seqid3=46.9 thrd1=0.156 thrd3=0.204 divg=0.111 Nucleic acid sequence=SEQ ID NO: 524 Amino acid sequence=SEQ ID NO: 1224; Antibody Heavy Chain No: 32667 germ=IGHV1-2*02 seqid1=47.1 seqid3=47.7 thrd1=0.218 thrd3=0.142 divg=0.108 Nucleic acid sequence=SEQ ID NO: 525 Amino acid sequence=SEQ ID NO: 1225; Antibody Heavy Chain No: 100962 germ=IGHV1-2*02 seqid1=51.2 seqid3=52.3 thrd1=0.185 thrd3=0.160 divg=0.108 Nucleic acid sequence=SEQ ID NO: 526 Amino acid sequence=SEQ ID NO: 1226; Antibody Heavy Chain No: 162078 germ=IGHV1-2*02 seqid1=51.2 seqid3=52.3 thrd1=0.185 thrd3=0.160 divg=0.108 Nucleic acid sequence=SEQ ID NO: 527 Amino acid sequence=SEQ ID NO: 1227; Antibody Heavy Chain No: 6353 germ=IGHV1-2*02 seqid1=51.2 seqid3=52.3 thrd1=0.185 thrd3=0.160 divg=0.108 Nucleic acid sequence=SEQ ID NO: 528 Amino acid sequence=SEQ ID NO: 1228; Antibody Heavy Chain No: 52276 germ=IGHV1-2*02 seqid1=51.2 seqid3=52.3 thrd1=0.185 thrd3=0.160 divg=0.108 Nucleic acid sequence=SEQ ID NO: 529 Amino acid sequence=SEQ ID NO: 1229; Antibody Heavy Chain No: 60197 germ=IGHV1-2*02 seqid1=47.1 seqid3=43.8 thrd1=0.149 thrd3=0.226 divg=0.108 Nucleic acid sequence=SEQ ID NO: 530 Amino acid sequence=SEQ ID NO: 1230; Antibody Heavy Chain No: 59165 germ=IGHV1-2*02 seqid1=47.9 seqid3=49.2 thrd1=0.186 thrd3=0.164 divg=0.108 Nucleic acid sequence=SEQ ID NO: 531 Amino acid sequence=SEQ ID NO: 1231; Antibody Heavy Chain No: 69714 germ=IGHV1-2*02 seqid1=53.7 seqid3=52.3 thrd1=0.156 thrd3=0.146 divg=0.108 Nucleic acid sequence=SEQ ID NO: 532 Amino acid sequence=SEQ ID NO: 1232; Antibody Heavy Chain No: 19770 germ=IGHV1-2*02 seqid1=52.1 seqid3=51.5 thrd1=0.184 thrd3=0.159 divg=0.108 Nucleic acid sequence=SEQ ID NO: 533 Amino acid sequence=SEQ ID NO: 1233; Antibody Heavy Chain No: 72439 germ=IGHV1-2*02 seqid1=47.9 seqid3=49.2 thrd1=0.184 thrd3=0.160 divg=0.108 Nucleic acid sequence=SEQ ID NO: 534 Amino acid sequence=SEQ ID NO: 1234; Antibody Heavy Chain No: 22551 germ=IGHV1-2*02 seqid1=51.2 seqid3=50.0 thrd1=0.207 thrd3=0.177 divg=0.108 Nucleic acid sequence=SEQ ID NO: 535 Amino acid sequence=SEQ ID NO: 1235; Antibody Heavy Chain No: 61263 germ=IGHV1-2*02 seqid1=51.2 seqid3=52.3 thrd1=0.185 thrd3=0.160 divg=0.108 Nucleic acid sequence=SEQ ID NO: 536 Amino acid sequence=SEQ ID NO: 1236; Antibody Heavy Chain No: 40709 germ=IGHV1-2*02 seqid1=51.2 seqid3=52.3 thrd1=0.185 thrd3=0.160 divg=0.108 Nucleic acid sequence=SEQ ID NO: 537 Amino acid sequence=SEQ ID NO: 1237; Antibody Heavy Chain No: 20145 germ=IGHV1-2*02 seqid1=52.1 seqid3=51.5 thrd1=0.184 thrd3=0.159 divg=0.108 Nucleic acid sequence=SEQ ID NO: 538 Amino acid sequence=SEQ ID NO: 1238; Antibody Heavy Chain No: 150344 germ=IGHV1-2*02 seqid1=51.2 seqid3=48.5 thrd1=0.158 thrd3=0.206 divg=0.108 Nucleic acid sequence=SEQ ID NO: 539 Amino acid sequence=SEQ ID NO: 1239; Antibody Heavy Chain No: 107592 germ=IGHV1-2*02 seqid1=52.1 seqid3=45.4 thrd1=0.123 thrd3=0.157 divg=0.108 Nucleic acid sequence=SEQ ID NO: 540 Amino acid sequence=SEQ ID NO: 1240; Antibody Heavy Chain No: 35068 germ=IGHV1-2*02 seqid1=51.2 seqid3=52.3 thrd1=0.185 thrd3=0.160 divg=0.108 Nucleic acid sequence=SEQ ID NO: 541 Amino acid sequence=SEQ ID NO: 1241; Antibody Heavy Chain No: 34274 germ=IGHV1-2*02 seqid1=51.2 seqid3=52.3 thrd1=0.185 thrd3=0.160 divg=0.108 Nucleic acid sequence=SEQ ID NO: 542 Amino acid sequence=SEQ ID NO: 1242; Antibody Heavy Chain No: 44773 germ=IGHV1-2*02 seqid1=51.2 seqid3=52.3 thrd1=0.185 thrd3=0.160 divg=0.108 Nucleic acid sequence=SEQ ID NO: 543 Amino acid sequence=SEQ ID NO: 1243; Antibody Heavy Chain No: 41319 germ=IGHV1-2*02 seqid1=48.8 seqid3=48.5 thrd1=0.206 thrd3=0.183 divg=0.108 Nucleic acid sequence=SEQ ID NO: 544 Amino acid sequence=SEQ ID NO: 1244; Antibody Heavy Chain No: 42823 germ=IGHV1-2*02 seqid1=51.2 seqid3=48.5 thrd1=0.158 thrd3=0.206 divg=0.108 Nucleic acid sequence=SEQ ID NO: 545 Amino acid sequence=SEQ ID NO: 1245; Antibody Heavy Chain No: 41670 germ=IGHV1-2*02 seqid1=55.4 seqid3=47.7 thrd1=0.124 thrd3=0.148 divg=0.108 Nucleic acid sequence=SEQ ID NO: 546 Amino acid sequence=SEQ ID NO: 1246; Antibody Heavy Chain No: 45717 germ=IGHV1-2*02 seqid1=49.6 seqid3=46.9 thrd1=0.155 thrd3=0.206 divg=0.108 Nucleic acid sequence=SEQ ID NO: 547 Amino acid sequence=SEQ ID NO: 1247; Antibody Heavy Chain No: 26052 germ=IGHV1-2*02 seqid1=51.2 seqid3=52.3 thrd1=0.185 thrd3=0.160 divg=0.108 Nucleic acid sequence=SEQ ID NO: 548 Amino acid sequence=SEQ ID NO: 1248; Antibody Heavy Chain No: 96832 germ=IGHV1-2*02 seqid1=47.9 seqid3=45.4 thrd1=0.173 thrd3=0.258 divg=0.108 Nucleic acid sequence=SEQ ID NO: 549 Amino acid sequence=SEQ ID NO: 1249; Antibody Heavy Chain No: 118499 germ=IGHV1-2*02 seqid1=49.6 seqid3=50.8 thrd1=0.185 thrd3=0.160 divg=0.108 Nucleic acid sequence=SEQ ID NO: 550 Amino acid sequence=SEQ ID NO: 1250; Antibody Heavy Chain No: 38820 germ=IGHV1-2*02 seqid1=47.9 seqid3=49.2 thrd1=0.186 thrd3=0.164 divg=0.108 Nucleic acid sequence=SEQ ID NO: 551 Amino acid sequence=SEQ ID NO: 1251; Antibody Heavy Chain No: 50301 germ=IGHV1-2*02 seqid1=51.2 seqid3=52.3 thrd1=0.185 thrd3=0.160 divg=0.108 Nucleic acid sequence=SEQ ID NO: 552 Amino acid sequence=SEQ ID NO: 1252; Antibody Heavy Chain No: 18973 germ=IGHV1-2*02 seqid1=51.2 seqid3=52.3 thrd1=0.185 thrd3=0.160 divg=0.108 Nucleic acid sequence=SEQ ID NO: 553 Amino acid sequence=SEQ ID NO: 1253; Antibody Heavy Chain No: 70392 germ=IGHV1-2*02 seqid1=52.1 seqid3=51.5 thrd1=0.184 thrd3=0.159 divg=0.108 Nucleic acid sequence=SEQ ID NO: 554 Amino acid sequence=SEQ ID NO: 1254; Antibody Heavy Chain No: 85662 germ=IGHV1-2*02 seqid1=51.2 seqid3=52.3 thrd1=0.185 thrd3=0.160 divg=0.108 Nucleic acid sequence=SEQ ID NO: 555 Amino acid sequence=SEQ ID NO: 1255; Antibody Heavy Chain No: 145143 germ=IGHV1-2*02 seqid1=51.2 seqid3=52.3 thrd1=0.185 thrd3=0.160 divg=0.108 Nucleic acid sequence=SEQ ID NO: 556 Amino acid sequence=SEQ ID NO: 1256; Antibody Heavy Chain No: 138251 germ=IGHV1-2*02 seqid1=48.8 seqid3=46.9 thrd1=0.184 thrd3=0.237 divg=0.108 Nucleic acid sequence=SEQ ID NO: 557 Amino acid sequence=SEQ ID NO: 1257; Antibody Heavy Chain No: 31587 germ=IGHV1-2*02 seqid1=51.2 seqid3=53.1 thrd1=0.297 thrd3=0.155 divg=0.108 Nucleic acid sequence=SEQ ID NO: 558 Amino acid sequence=SEQ ID NO: 1258; Antibody Heavy Chain No: 62466 germ=IGHV1-2*02 seqid1=49.6 seqid3=48.5 thrd1=0.156 thrd3=0.218 divg=0.108 Nucleic acid sequence=SEQ ID NO: 559 Amino acid sequence=SEQ ID NO: 1259; Antibody Heavy Chain No: 131429 germ=IGHV1-2*02 seqid1=51.2 seqid3=48.5 thrd1=0.158 thrd3=0.206 divg=0.108 Nucleic acid sequence=SEQ ID NO: 560 Amino acid sequence=SEQ ID NO: 1260; Antibody Heavy Chain No: 44658 germ=IGHV1-2*02 seqid1=51.2 seqid3=47.7 thrd1=0.156 thrd3=0.207 divg=0.108 Nucleic acid sequence=SEQ ID NO: 561 Amino acid sequence=SEQ ID NO: 1261; Antibody Heavy Chain No: 144844 germ=IGHV1-2*02 seqid1=51.2 seqid3=52.3 thrd1=0.185 thrd3=0.160 divg=0.108 Nucleic acid sequence=SEQ ID NO: 562 Amino acid sequence=SEQ ID NO: 1262; Antibody Heavy Chain No: 44516 germ=IGHV1-2*02 seqid1=51.2 seqid3=48.5 thrd1=0.158 thrd3=0.206 divg=0.108 Nucleic acid sequence=SEQ ID NO: 563 Amino acid sequence=SEQ ID NO: 1263; Antibody Heavy Chain No: 54766 germ=IGHV1-2*02 seqid1=52.1 seqid3=46.9 thrd1=0.199 thrd3=0.152 divg=0.105 Nucleic acid sequence=SEQ ID NO: 564 Amino acid sequence=SEQ ID NO: 1264; Antibody Heavy Chain No: 76743 germ=IGHV1-2*02 seqid1=53.7 seqid3=49.2 thrd1=0.172 thrd3=0.194 divg=0.105 Nucleic acid sequence=SEQ ID NO: 565 Amino acid sequence=SEQ ID NO: 1265; Antibody Heavy Chain No: 104654 germ=IGHV1-2*02 seqid1=47.9 seqid3=43.8 thrd1=0.169 thrd3=0.140 divg=0.105 Nucleic acid sequence=SEQ ID NO: 566 Amino acid sequence=SEQ ID NO: 1266; Antibody Heavy Chain No: 124687 germ=IGHV1-2*02 seqid1=47.1 seqid3=48.5 thrd1=0.189 thrd3=0.166 divg=0.105 Nucleic acid sequence=SEQ ID NO: 567 Amino acid sequence=SEQ ID NO: 1267; Antibody Heavy Chain No: 49649 germ=IGHV1-2*02 seqid1=53.7 seqid3=49.2 thrd1=0.171 thrd3=0.193 divg=0.105 Nucleic acid sequence=SEQ ID NO: 568 Amino acid sequence=SEQ ID NO: 1268; Antibody Heavy Chain No: 74653 germ=IGHV1-2*02 seqid1=50.4 seqid3=49.2 thrd1=0.156 thrd3=0.148 divg=0.105 Nucleic acid sequence=SEQ ID NO: 569 Amino acid sequence=SEQ ID NO: 1269; Antibody Heavy Chain No: 106878 germ=IGHV1-2*02 seqid1=49.6 seqid3=50.0 thrd1=0.186 thrd3=0.121 divg=0.105 Nucleic acid sequence=SEQ ID NO: 570 Amino acid sequence=SEQ ID NO: 1270; Antibody Heavy Chain No: 86161 germ=IGHV1-2*02 seqid1=52.1 seqid3=54.6 thrd1=0.159 thrd3=0.133 divg=0.105 Nucleic acid sequence=SEQ ID NO: 571 Amino acid sequence=SEQ ID NO: 1271; Antibody Heavy Chain No: 35923 germ=IGHV1-2*02 seqid1=51.2 seqid3=50.8 thrd1=0.173 thrd3=0.165 divg=0.105 Nucleic acid sequence=SEQ ID NO: 572 Amino acid sequence=SEQ ID NO: 1272; Antibody Heavy Chain No: 76480 germ=IGHV1-2*02 seqid1=32.2 seqid3=36.2 thrd1=0.272 thrd3=0.301 divg=0.105 Nucleic acid sequence=SEQ ID NO: 573 Amino acid sequence=SEQ ID NO: 1273; Antibody Heavy Chain No: 19179 germ=IGHV1-2*02 seqid1=52.1 seqid3=54.6 thrd1=0.159 thrd3=0.133 divg=0.105 Nucleic acid sequence=SEQ ID NO: 574 Amino acid sequence=SEQ ID NO: 1274; Antibody Heavy Chain No: 42178 germ=IGHV1-2*02 seqid1=52.9 seqid3=50.8 thrd1=0.312 thrd3=0.189 divg=0.105 Nucleic acid sequence=SEQ ID NO: 575 Amino acid sequence=SEQ ID NO: 1275; Antibody Heavy Chain No: 149342 germ=IGHV1-2*02 seqid1=52.1 seqid3=48.5 thrd1=0.170 thrd3=0.140 divg=0.101 Nucleic acid sequence=SEQ ID NO: 576 Amino acid sequence=SEQ ID NO: 1276; Antibody Heavy Chain No: 12940 germ=IGHV1-2*02 seqid1=55.4 seqid3=52.3 thrd1=0.176 thrd3=0.131 divg=0.101 Nucleic acid sequence=SEQ ID NO: 577 Amino acid sequence=SEQ ID NO: 1277; Antibody Heavy Chain No: 50102 germ=IGHV1-2*02 seqid1=54.5 seqid3=52.3 thrd1=0.176 thrd3=0.131 divg=0.101 Nucleic acid sequence=SEQ ID NO: 578 Amino acid sequence=SEQ ID NO: 1278; Antibody Heavy Chain No: 57948 germ=IGHV1-2*02 seqid1=52.9 seqid3=54.6 thrd1=0.159 thrd3=0.136 divg=0.101 Nucleic acid sequence=SEQ ID NO: 579 Amino acid sequence=SEQ ID NO: 1279; Antibody Heavy Chain No: 58689 germ=IGHV1-2*02 seqid1=55.4 seqid3=52.3 thrd1=0.176 thrd3=0.131 divg=0.101 Nucleic acid sequence=SEQ ID NO: 580 Amino acid sequence=SEQ ID NO: 1280; Antibody Heavy Chain No: 67595 germ=IGHV1-2*02 seqid1=50.4 seqid3=49.2 thrd1=0.156 thrd3=0.148 divg=0.101 Nucleic acid sequence=SEQ ID NO: 581 Amino acid sequence=SEQ ID NO: 1281; Antibody Heavy Chain No: 39805 germ=IGHV1-2*02 seqid1=54.5 seqid3=52.3 thrd1=0.176 thrd3=0.131 divg=0.101 Nucleic acid sequence=SEQ ID NO: 582 Amino acid sequence=SEQ ID NO: 1282; Antibody Heavy Chain No: 8184 germ=IGHV1-2*02 seqid1=52.1 seqid3=49.2 thrd1=0.143 thrd3=0.104 divg=0.101 Nucleic acid sequence=SEQ ID NO: 583 Amino acid sequence=SEQ ID NO: 1283; Antibody Heavy Chain No: 28484 germ=IGHV1-2*02 seqid1=46.3 seqid3=46.2 thrd1=0.173 thrd3=0.142 divg=0.101 Nucleic acid sequence=SEQ ID NO: 584 Amino acid sequence=SEQ ID NO: 1284; Antibody Heavy Chain No: 94185 germ=IGHV1-2*02 seqid1=55.4 seqid3=52.3 thrd1=0.176 thrd3=0.131 divg=0.101 Nucleic acid sequence=SEQ ID NO: 585 Amino acid sequence=SEQ ID NO: 1285; Antibody Heavy Chain No: 43787 germ=IGHV1-2*02 seqid1=52.1 seqid3=49.2 thrd1=0.174 thrd3=0.133 divg=0.101 Nucleic acid sequence=SEQ ID NO: 586 Amino acid sequence=SEQ ID NO: 1286; Antibody Heavy Chain No: 83620 germ=IGHV1-2*02 seqid1=55.4 seqid3=53.8 thrd1=0.243 thrd3=0.147 divg=0.101 Nucleic acid sequence=SEQ ID NO: 587 Amino acid sequence=SEQ ID NO: 1287; Antibody Heavy Chain No: 39478 germ=IGHV1-2*02 seqid1=55.4 seqid3=52.3 thrd1=0.176 thrd3=0.131 divg=0.101 Nucleic acid sequence=SEQ ID NO: 588 Amino acid sequence=SEQ ID NO: 1288; Antibody Heavy Chain No: 131276 germ=IGHV1-2*02 seqid1=52.1 seqid3=48.5 thrd1=0.176 thrd3=0.135 divg=0.101 Nucleic acid sequence=SEQ ID NO: 589 Amino acid sequence=SEQ ID NO: 1289; Antibody Heavy Chain No: 163473 germ=IGHV1-2*02 seqid1=50.4 seqid3=46.2 thrd1=0.220 thrd3=0.190 divg=0.101 Nucleic acid sequence=SEQ ID NO: 590 Amino acid sequence=SEQ ID NO: 1290; Antibody Heavy Chain No: 56704 germ=IGHV1-2*02 seqid1=53.7 seqid3=51.5 thrd1=0.143 thrd3=0.121 divg=0.101 Nucleic acid sequence=SEQ ID NO: 591 Amino acid sequence=SEQ ID NO: 1291; Antibody Heavy Chain No: 154264 germ=IGHV1-2*02 seqid1=54.5 seqid3=52.3 thrd1=0.176 thrd3=0.131 divg=0.101 Nucleic acid sequence=SEQ ID NO: 592 Amino acid sequence=SEQ ID NO: 1292; Antibody Heavy Chain No: 158278 germ=IGHV1-2*02 seqid1=52.1 seqid3=47.7 thrd1=0.231 thrd3=0.132 divg=0.101 Nucleic acid sequence=SEQ ID NO: 593 Amino acid sequence=SEQ ID NO: 1293; Antibody Heavy Chain No: 34490 germ=IGHV1-2*02 seqid1=51.2 seqid3=49.2 thrd1=0.162 thrd3=0.174 divg=0.101 Nucleic acid sequence=SEQ ID NO: 594 Amino acid sequence=SEQ ID NO: 1294; Antibody Heavy Chain No: 77433 germ=IGHV1-2*02 seqid1=47.9 seqid3=47.7 thrd1=0.131 thrd3=0.140 divg=0.101 Nucleic acid sequence=SEQ ID NO: 595 Amino acid sequence=SEQ ID NO: 1295; Antibody Heavy Chain No: 93604 germ=IGHV1-2*02 seqid1=51.2 seqid3=49.2 thrd1=0.159 thrd3=0.203 divg=0.098 Nucleic acid sequence=SEQ ID NO: 596 Amino acid sequence=SEQ ID NO: 1296; Antibody Heavy Chain No: 165480 germ=IGHV1-2*02 seqid1=54.5 seqid3=50.0 thrd1=0.174 thrd3=0.195 divg=0.098 Nucleic acid sequence=SEQ ID NO: 597 Amino acid sequence=SEQ ID NO: 1297; Antibody Heavy Chain No: 89337 germ=IGHV1-2*02 seqid1=50.4 seqid3=46.2 thrd1=0.191 thrd3=0.294 divg=0.098 Nucleic acid sequence=SEQ ID NO: 598 Amino acid sequence=SEQ ID NO: 1298; Antibody Heavy Chain No: 141896 germ=IGHV1-2*02 seqid1=51.2 seqid3=50.0 thrd1=0.179 thrd3=0.189 divg=0.098 Nucleic acid sequence=SEQ ID NO: 599 Amino acid sequence=SEQ ID NO: 1299; Antibody Heavy Chain No: 6626 germ=IGHV1-2*02 seqid1=54.5 seqid3=51.5 thrd1=0.178 thrd3=0.184 divg=0.098 Nucleic acid sequence=SEQ ID NO: 600 Amino acid sequence=SEQ ID NO: 1300; Antibody Heavy Chain No: 181213 germ=IGHV1-2*02 seqid1=52.1 seqid3=48.5 thrd1=0.174 thrd3=0.131 divg=0.098 Nucleic acid sequence=SEQ ID NO: 601 Amino acid sequence=SEQ ID NO: 1301; Antibody Heavy Chain No: 22196 germ=IGHV1-2*02 seqid1=54.5 seqid3=50.0 thrd1=0.174 thrd3=0.195 divg=0.098 Nucleic acid sequence=SEQ ID NO: 602 Amino acid sequence=SEQ ID NO: 1302; Antibody Heavy Chain No: 30474 germ=IGHV1-2*02 seqid1=54.5 seqid3=48.5 thrd1=0.242 thrd3=0.156 divg=0.098 Nucleic acid sequence=SEQ ID NO: 603 Amino acid sequence=SEQ ID NO: 1303; Antibody Heavy Chain No: 125701 germ=IGHV1-2*02 seqid1=54.5 seqid3=47.7 thrd1=0.203 thrd3=0.190 divg=0.098 Nucleic acid sequence=SEQ ID NO: 604 Amino acid sequence=SEQ ID NO: 1304; Antibody Heavy Chain No: 9945 germ=IGHV1-2*02 seqid1=56.2 seqid3=51.5 thrd1=0.160 thrd3=0.126 divg=0.098 Nucleic acid sequence=SEQ ID NO: 605 Amino acid sequence=SEQ ID NO: 1305; Antibody Heavy Chain No: 40778 germ=IGHV1-2*02 seqid1=51.2 seqid3=47.7 thrd1=0.171 thrd3=0.176 divg=0.098 Nucleic acid sequence=SEQ ID NO: 606 Amino acid sequence=SEQ ID NO: 1306; Antibody Heavy Chain No: 4513 germ=IGHV1-2*02 seqid1=52.9 seqid3=52.3 thrd1=0.170 thrd3=0.157 divg=0.098 Nucleic acid sequence=SEQ ID NO: 607 Amino acid sequence=SEQ ID NO: 1307; Antibody Heavy Chain No: 134442 germ=IGHV1-2*02 seqid1=55.4 seqid3=53.8 thrd1=0.241 thrd3=0.155 divg=0.098 Nucleic acid sequence=SEQ ID NO: 608 Amino acid sequence=SEQ ID NO: 1308; Antibody Heavy Chain No: 140333 germ=IGHV1-2*02 seqid1=56.2 seqid3=51.5 thrd1=0.171 thrd3=0.138 divg=0.098 Nucleic acid sequence=SEQ ID NO: 609 Amino acid sequence=SEQ ID NO: 1309; Antibody Heavy Chain No: 105176 germ=IGHV1-2*02 seqid1=56.2 seqid3=52.3 thrd1=0.164 thrd3=0.121 divg=0.098 Nucleic acid sequence=SEQ ID NO: 610 Amino acid sequence=SEQ ID NO: 1310; Antibody Heavy Chain No: 80243 germ=IGHV1-2*02 seqid1=54.5 seqid3=52.3 thrd1=0.176 thrd3=0.131 divg=0.098 Nucleic acid sequence=SEQ ID NO: 611 Amino acid sequence=SEQ ID NO: 1311; Antibody Heavy Chain No: 9911 germ=IGHV1-2*02 seqid1=53.7 seqid3=52.3 thrd1=0.146 thrd3=0.136 divg=0.098 Nucleic acid sequence=SEQ ID NO: 612 Amino acid sequence=SEQ ID NO: 1312; Antibody Heavy Chain No: 29294 germ=IGHV1-2*02 seqid1=55.4 seqid3=47.7 thrd1=0.159 thrd3=0.120 divg=0.098 Nucleic acid sequence=SEQ ID NO: 613 Amino acid sequence=SEQ ID NO: 1313; Antibody Heavy Chain No: 34606 germ=IGHV1-2*02 seqid1=54.5 seqid3=52.3 thrd1=0.176 thrd3=0.131 divg=0.098 Nucleic acid sequence=SEQ ID NO: 614 Amino acid sequence=SEQ ID NO: 1314; Antibody Heavy Chain No: 81062 germ=IGHV1-2*02 seqid1=55.4 seqid3=47.7 thrd1=0.159 thrd3=0.120 divg=0.095 Nucleic acid sequence=SEQ ID NO: 615 Amino acid sequence=SEQ ID NO: 1315; Antibody Heavy Chain No: 57203 germ=IGHV1-2*02 seqid1=59.5 seqid3=52.3 thrd1=0.134 thrd3=0.180 divg=0.095 Nucleic acid sequence=SEQ ID NO: 616 Amino acid sequence=SEQ ID NO: 1316; Antibody Heavy Chain No: 43280 germ=IGHV1-2*02 seqid1=54.5 seqid3=51.5 thrd1=0.181 thrd3=0.193 divg=0.095 Nucleic acid sequence=SEQ ID NO: 617 Amino acid sequence=SEQ ID NO: 1317; Antibody Heavy Chain No: 115669 germ=IGHV1-2*02 seqid1=54.5 seqid3=51.5 thrd1=0.183 thrd3=0.139 divg=0.095 Nucleic acid sequence=SEQ ID NO: 618 Amino acid sequence=SEQ ID NO: 1318; Antibody Heavy Chain No: 70426 germ=IGHV1-2*02 seqid1=53.7 seqid3=52.3 thrd1=0.144 thrd3=0.137 divg=0.095 Nucleic acid sequence=SEQ ID NO: 619 Amino acid sequence=SEQ ID NO: 1319; Antibody Heavy Chain No: 72666 germ=IGHV1-2*02 seqid1=47.9 seqid3=45.4 thrd1=0.220 thrd3=0.242 divg=0.095 Nucleic acid sequence=SEQ ID NO: 620 Amino acid sequence=SEQ ID NO: 1320; Antibody Heavy Chain No: 119442 germ=IGHV1-2*02 seqid1=43.0 seqid3=39.2 thrd1=0.250 thrd3=0.209 divg=0.095 Nucleic acid sequence=SEQ ID NO: 621 Amino acid sequence=SEQ ID NO: 1321; Antibody Heavy Chain No: 143549 germ=IGHV1-2*02 seqid1=51.2 seqid3=48.5 thrd1=0.222 thrd3=0.280 divg=0.095 Nucleic acid sequence=SEQ ID NO: 622 Amino acid sequence=SEQ ID NO: 1322; Antibody Heavy Chain No: 29700 germ=IGHV1-2*02 seqid1=49.6 seqid3=52.3 thrd1=0.160 thrd3=0.089 divg=0.095 Nucleic acid sequence=SEQ ID NO: 623 Amino acid sequence=SEQ ID NO: 1323; Antibody Heavy Chain No: 28564 germ=IGHV1-2*02 seqid1=52.9 seqid3=49.2 thrd1=0.163 thrd3=0.124 divg=0.095 Nucleic acid sequence=SEQ ID NO: 624 Amino acid sequence=SEQ ID NO: 1324; Antibody Heavy Chain No: 52736 germ=IGHV1-2*02 seqid1=54.5 seqid3=51.5 thrd1=0.181 thrd3=0.193 divg=0.095 Nucleic acid sequence=SEQ ID NO: 625 Amino acid sequence=SEQ ID NO: 1325; Antibody Heavy Chain No: 105785 germ=IGHV1-2*02 seqid1=53.7 seqid3=52.3 thrd1=0.173 thrd3=0.188 divg=0.095 Nucleic acid sequence=SEQ ID NO: 626 Amino acid sequence=SEQ ID NO: 1326; Antibody Heavy Chain No: 12559 germ=IGHV1-2*02 seqid1=49.6 seqid3=52.3 thrd1=0.160 thrd3=0.089 divg=0.095 Nucleic acid sequence=SEQ ID NO: 627 Amino acid sequence=SEQ ID NO: 1327; Antibody Heavy Chain No: 126568 germ=IGHV1-2*02 seqid1=56.2 seqid3=52.3 thrd1=0.164 thrd3=0.121 divg=0.095 Nucleic acid sequence=SEQ ID NO: 628 Amino acid sequence=SEQ ID NO: 1328; Antibody Heavy Chain No: 93926 germ=IGHV1-2*02 seqid1=49.6 seqid3=52.3 thrd1=0.160 thrd3=0.089 divg=0.095 Nucleic acid sequence=SEQ ID NO: 629 Amino acid sequence=SEQ ID NO: 1329; Antibody Heavy Chain No: 50697 germ=IGHV1-2*02 seqid1=49.6 seqid3=52.3 thrd1=0.160 thrd3=0.089 divg=0.095 Nucleic acid sequence=SEQ ID NO: 630 Amino acid sequence=SEQ ID NO: 1330; Antibody Heavy Chain No: 44028 germ=IGHV1-2*02 seqid1=53.7 seqid3=51.5 thrd1=0.148 thrd3=0.120 divg=0.095 Nucleic acid sequence=SEQ ID NO: 631 Amino acid sequence=SEQ ID NO: 1331; Antibody Heavy Chain No: 43578 germ=IGHV1-2*02 seqid1=55.4 seqid3=51.5 thrd1=0.171 thrd3=0.190 divg=0.095 Nucleic acid sequence=SEQ ID NO: 632 Amino acid sequence=SEQ ID NO: 1332; Antibody Heavy Chain No: 41655 germ=IGHV1-2*02 seqid1=51.2 seqid3=48.5 thrd1=0.180 thrd3=0.193 divg=0.095 Nucleic acid sequence=SEQ ID NO: 633 Amino acid sequence=SEQ ID NO: 1333; Antibody Heavy Chain No: 74815 germ=IGHV1-2*02 seqid1=55.4 seqid3=50.8 thrd1=0.173 thrd3=0.193 divg=0.095 Nucleic acid sequence=SEQ ID NO: 634 Amino acid sequence=SEQ ID NO: 1334; Antibody Heavy Chain No: 8194 germ=IGHV1-2*02 seqid1=38.0 seqid3=39.2 thrd1=0.235 thrd3=0.238 divg=0.095 Nucleic acid sequence=SEQ ID NO: 635 Amino acid sequence=SEQ ID NO: 1335; Antibody Heavy Chain No: 141541 germ=IGHV1-2*02 seqid1=50.4 seqid3=50.8 thrd1=0.167 thrd3=0.213 divg=0.095 Nucleic acid sequence=SEQ ID NO: 636 Amino acid sequence=SEQ ID NO: 1336; Antibody Heavy Chain No: 24104 germ=IGHV1-2*02 seqid1=50.4 seqid3=49.2 thrd1=0.177 thrd3=0.145 divg=0.095 Nucleic acid sequence=SEQ ID NO: 637 Amino acid sequence=SEQ ID NO: 1337; Antibody Heavy Chain No: 38838 germ=IGHV1-2*02 seqid1=55.4 seqid3=52.3 thrd1=0.166 thrd3=0.121 divg=0.095 Nucleic acid sequence=SEQ ID NO: 638 Amino acid sequence=SEQ ID NO: 1338; Antibody Heavy Chain No: 17924 germ=IGHV1-2*02 seqid1=52.1 seqid3=46.9 thrd1=0.227 thrd3=0.194 divg=0.095 Nucleic acid sequence=SEQ ID NO: 639 Amino acid sequence=SEQ ID NO: 1339; Antibody Heavy Chain No: 13341 germ=IGHV1-2*02 seqid1=52.9 seqid3=47.7 thrd1=0.122 thrd3=0.145 divg=0.095 Nucleic acid sequence=SEQ ID NO: 640 Amino acid sequence=SEQ ID NO: 1340; Antibody Heavy Chain No: 35429 germ=IGHV1-2*02 seqid1=53.7 seqid3=52.3 thrd1=0.173 thrd3=0.188 divg=0.095 Nucleic acid sequence=SEQ ID NO: 641 Amino acid sequence=SEQ ID NO: 1341; Antibody Heavy Chain No: 34820 germ=IGHV1-2*02 seqid1=55.4 seqid3=51.5 thrd1=0.178 thrd3=0.133 divg=0.095 Nucleic acid sequence=SEQ ID NO: 642 Amino acid sequence=SEQ ID NO: 1342; Antibody Heavy Chain No: 65892 germ=IGHV1-2*02 seqid1=55.4 seqid3=52.3 thrd1=0.167 thrd3=0.122 divg=0.095 Nucleic acid sequence=SEQ ID NO: 643 Amino acid sequence=SEQ ID NO: 1343; Antibody Heavy Chain No: 51501 germ=IGHV1-2*02 seqid1=51.2 seqid3=47.7 thrd1=0.144 thrd3=0.104 divg=0.095 Nucleic acid sequence=SEQ ID NO: 644 Amino acid sequence=SEQ ID NO: 1344; Antibody Heavy Chain No: 98150 germ=IGHV1-2*02 seqid1=53.7 seqid3=45.4 thrd1=0.117 thrd3=0.140 divg=0.095 Nucleic acid sequence=SEQ ID NO: 645 Amino acid sequence=SEQ ID NO: 1345; Antibody Heavy Chain No: 12243 germ=IGHV1-2*02 seqid1=48.8 seqid3=49.2 thrd1=0.206 thrd3=0.139 divg=0.095 Nucleic acid sequence=SEQ ID NO: 646 Amino acid sequence=SEQ ID NO: 1346; Antibody Heavy Chain No: 77718 germ=IGHV1-2*02 seqid1=55.4 seqid3=52.3 thrd1=0.178 thrd3=0.133 divg=0.095 Nucleic acid sequence=SEQ ID NO: 647 Amino acid sequence=SEQ ID NO: 1347; Antibody Heavy Chain No: 32593 germ=IGHV1-2*02 seqid1=52.1 seqid3=46.9 thrd1=0.122 thrd3=0.145 divg=0.095 Nucleic acid sequence=SEQ ID NO: 648 Amino acid sequence=SEQ ID NO: 1348; Antibody Heavy Chain No: 32228 germ=IGHV1-2*02 seqid1=55.4 seqid3=50.8 thrd1=0.173 thrd3=0.193 divg=0.095 Nucleic acid sequence=SEQ ID NO: 649 Amino acid sequence=SEQ ID NO: 1349; Antibody Heavy Chain No: 8376 germ=IGHV1-2*02 seqid1=49.6 seqid3=50.0 thrd1=0.163 thrd3=0.205 divg=0.091 Nucleic acid sequence=SEQ ID NO: 650 Amino acid sequence=SEQ ID NO: 1350; Antibody Heavy Chain No: 81308 germ=IGHV1-2*02 seqid1=50.4 seqid3=49.2 thrd1=0.157 thrd3=0.145 divg=0.091 Nucleic acid sequence=SEQ ID NO: 651 Amino acid sequence=SEQ ID NO: 1351; Antibody Heavy Chain No: 11518 germ=IGHV1-2*02 seqid1=48.8 seqid3=48.5 thrd1=0.126 thrd3=0.141 divg=0.091 Nucleic acid sequence=SEQ ID NO: 652 Amino acid sequence=SEQ ID NO: 1352; Antibody Heavy Chain No: 73361 germ=IGHV1-2*02 seqid1=54.5 seqid3=51.5 thrd1=0.181 thrd3=0.134 divg=0.091 Nucleic acid sequence=SEQ ID NO: 653 Amino acid sequence=SEQ ID NO: 1353; Antibody Heavy Chain No: 32234 germ=IGHV1-2*02 seqid1=56.2 seqid3=52.3 thrd1=0.164 thrd3=0.121 divg=0.091 Nucleic acid sequence=SEQ ID NO: 654 Amino acid sequence=SEQ ID NO: 1354; Antibody Heavy Chain No: 22598 germ=IGHV1-2*02 seqid1=51.2 seqid3=49.2 thrd1=0.218 thrd3=0.142 divg=0.091 Nucleic acid sequence=SEQ ID NO: 655 Amino acid sequence=SEQ ID NO: 1355; Antibody Heavy Chain No: 82491 germ=IGHV1-2*02 seqid1=55.4 seqid3=50.8 thrd1=0.209 thrd3=0.100 divg=0.091 Nucleic acid sequence=SEQ ID NO: 656 Amino acid sequence=SEQ ID NO: 1356; Antibody Heavy Chain No: 22197 germ=IGHV1-2*02 seqid1=50.4 seqid3=46.9 thrd1=0.171 thrd3=0.177 divg=0.091 Nucleic acid sequence=SEQ ID NO: 657 Amino acid sequence=SEQ ID NO: 1357; Antibody Heavy Chain No: 22110 germ=IGHV1-2*02 seqid1=52.9 seqid3=49.2 thrd1=0.198 thrd3=0.154 divg=0.091 Nucleic acid sequence=SEQ ID NO: 658 Amino acid sequence=SEQ ID NO: 1358; Antibody Heavy Chain No: 10233 germ=IGHV1-2*02 seqid1=55.4 seqid3=52.3 thrd1=0.176 thrd3=0.131 divg=0.091 Nucleic acid sequence=SEQ ID NO: 659 Amino acid sequence=SEQ ID NO: 1359; Antibody Heavy Chain No: 59890 germ=IGHV1-2*02 seqid1=55.4 seqid3=52.3 thrd1=0.176 thrd3=0.131 divg=0.091 Nucleic acid sequence=SEQ ID NO: 660 Amino acid sequence=SEQ ID NO: 1360; Antibody Heavy Chain No: 72262 germ=IGHV1-2*02 seqid1=38.0 seqid3=43.1 thrd1=0.331 thrd3=0.259 divg=0.091 Nucleic acid sequence=SEQ ID NO: 661 Amino acid sequence=SEQ ID NO: 1361; Antibody Heavy Chain No: 101709 germ=IGHV1-2*02 seqid1=52.1 seqid3=47.7 thrd1=0.143 thrd3=0.103 divg=0.091 Nucleic acid sequence=SEQ ID NO: 662 Amino acid sequence=SEQ ID NO: 1362; Antibody Heavy Chain No: 64491 germ=IGHV1-2*02 seqid1=56.2 seqid3=52.3 thrd1=0.164 thrd3=0.121 divg=0.091 Nucleic acid sequence=SEQ ID NO: 663 Amino acid sequence=SEQ ID NO: 1363; Antibody Heavy Chain No: 68980 germ=IGHV1-2*02 seqid1=56.2 seqid3=51.5 thrd1=0.158 thrd3=0.138 divg=0.091 Nucleic acid sequence=SEQ ID NO: 664 Amino acid sequence=SEQ ID NO: 1364; Antibody Heavy Chain No: 106681 germ=IGHV1-2*02 seqid1=53.7 seqid3=51.5 thrd1=0.148 thrd3=0.120 divg=0.091 Nucleic acid sequence=SEQ ID NO: 665 Amino acid sequence=SEQ ID NO: 1365; Antibody Heavy Chain No: 9252 germ=IGHV1-2*02 seqid1=52.1 seqid3=49.2 thrd1=0.161 thrd3=0.151 divg=0.091 Nucleic acid sequence=SEQ ID NO: 666 Amino acid sequence=SEQ ID NO: 1366; Antibody Heavy Chain No: 9061 germ=IGHV1-2*02 seqid1=55.4 seqid3=52.3 thrd1=0.176 thrd3=0.131 divg=0.091 Nucleic acid sequence=SEQ ID NO: 667 Amino acid sequence=SEQ ID NO: 1367; Antibody Heavy Chain No: 47729 germ=IGHV1-2*02 seqid1=55.4 seqid3=52.3 thrd1=0.176 thrd3=0.131 divg=0.091 Nucleic acid sequence=SEQ ID NO: 668 Amino acid sequence=SEQ ID NO: 1368; Antibody Heavy Chain No: 61890 germ=IGHV1-2*02 seqid1=51.2 seqid3=49.2 thrd1=0.147 thrd3=0.119 divg=0.091 Nucleic acid sequence=SEQ ID NO: 669 Amino acid sequence=SEQ ID NO: 1369; Antibody Heavy Chain No: 44167 germ=IGHV1-2*02 seqid1=53.7 seqid3=51.5 thrd1=0.148 thrd3=0.120 divg=0.091 Nucleic acid sequence=SEQ ID NO: 670 Amino acid sequence=SEQ ID NO: 1370; Antibody Heavy Chain No: 88530 germ=IGHV1-2*02 seqid1=33.1 seqid3=35.4 thrd1=0.208 thrd3=0.361 divg=0.091 Nucleic acid sequence=SEQ ID NO: 671 Amino acid sequence=SEQ ID NO: 1371; Antibody Heavy Chain No: 113877 germ=IGHV1-2*02 seqid1=41.3 seqid3=42.3 thrd1=0.277 thrd3=0.259 divg=0.091 Nucleic acid sequence=SEQ ID NO: 672 Amino acid sequence=SEQ ID NO: 1372; Antibody Heavy Chain No: 14850 germ=IGHV1-2*02 seqid1=54.5 seqid3=51.5 thrd1=0.181 thrd3=0.134 divg=0.091 Nucleic acid sequence=SEQ ID NO: 673 Amino acid sequence=SEQ ID NO: 1373; Antibody Heavy Chain No: 35041 germ=IGHV1-2*02 seqid1=54.5 seqid3=51.5 thrd1=0.181 thrd3=0.134 divg=0.091 Nucleic acid sequence=SEQ ID NO: 674 Amino acid sequence=SEQ ID NO: 1374; Antibody Heavy Chain No: 33864 germ=IGHV1-2*02 seqid1=56.2 seqid3=52.3 thrd1=0.164 thrd3=0.121 divg=0.091 Nucleic acid sequence=SEQ ID NO: 675 Amino acid sequence=SEQ ID NO: 1375; Antibody Heavy Chain No: 10721 germ=IGHV1-2*02 seqid1=54.5 seqid3=51.5 thrd1=0.181 thrd3=0.134 divg=0.091 Nucleic acid sequence=SEQ ID NO: 676 Amino acid sequence=SEQ ID NO: 1376; Antibody Heavy Chain No: 100562 germ=IGHV1-2*02 seqid1=55.4 seqid3=52.3 thrd1=0.176 thrd3=0.131 divg=0.091 Nucleic acid sequence=SEQ ID NO: 677 Amino acid sequence=SEQ ID NO: 1377; Antibody Heavy Chain No: 54476 germ=IGHV1-2*02 seqid1=54.5 seqid3=51.5 thrd1=0.181 thrd3=0.134 divg=0.091 Nucleic acid sequence=SEQ ID NO: 678 Amino acid sequence=SEQ ID NO: 1378; Antibody Heavy Chain No: 22270 germ=IGHV1-2*02 seqid1=52.1 seqid3=49.2 thrd1=0.176 thrd3=0.135 divg=0.091 Nucleic acid sequence=SEQ ID NO: 679 Amino acid sequence=SEQ ID NO: 1379; Antibody Heavy Chain No: 115874 germ=IGHV1-2*02 seqid1=55.4 seqid3=52.3 thrd1=0.176 thrd3=0.131 divg=0.091 Nucleic acid sequence=SEQ ID NO: 680 Amino acid sequence=SEQ ID NO: 1380; Antibody Heavy Chain No: 87027 germ=IGHV1-2*02 seqid1=52.1 seqid3=48.5 thrd1=0.204 thrd3=0.144 divg=0.091 Nucleic acid sequence=SEQ ID NO: 681 Amino acid sequence=SEQ ID NO: 1381; Antibody Heavy Chain No: 35015 germ=IGHV1-2*02 seqid1=55.4 seqid3=52.3 thrd1=0.176 thrd3=0.131 divg=0.091 Nucleic acid sequence=SEQ ID NO: 682 Amino acid sequence=SEQ ID NO: 1382; Antibody Heavy Chain No: 148767 germ=IGHV1-2*02 seqid1=55.4 seqid3=52.3 thrd1=0.176 thrd3=0.131 divg=0.091 Nucleic acid sequence=SEQ ID NO: 683 Amino acid sequence=SEQ ID NO: 1383; Antibody Heavy Chain No: 28267 germ=IGHV1-2*02 seqid1=50.4 seqid3=46.2 thrd1=0.195 thrd3=0.213 divg=0.088 Nucleic acid sequence=SEQ ID NO: 684 Amino acid sequence=SEQ ID NO: 1384; Antibody Heavy Chain No: 63967 germ=IGHV1-2*02 seqid1=48.8 seqid3=46.9 thrd1=0.193 thrd3=0.176 divg=0.088 Nucleic acid sequence=SEQ ID NO: 685 Amino acid sequence=SEQ ID NO: 1385; Antibody Heavy Chain No: 23404 germ=IGHV1-2*02 seqid1=50.4 seqid3=50.8 thrd1=0.146 thrd3=0.134 divg=0.088 Nucleic acid sequence=SEQ ID NO: 686 Amino acid sequence=SEQ ID NO: 1386; Antibody Heavy Chain No: 137385 germ=IGHV1-2*02 seqid1=52.9 seqid3=50.8 thrd1=0.188 thrd3=0.184 divg=0.088 Nucleic acid sequence=SEQ ID NO: 687 Amino acid sequence=SEQ ID NO: 1387; Antibody Heavy Chain No: 24631 germ=IGHV1-2*02 seqid1=54.5 seqid3=53.1 thrd1=0.147 thrd3=0.136 divg=0.088 Nucleic acid sequence=SEQ ID NO: 688 Amino acid sequence=SEQ ID NO: 1388; Antibody Heavy Chain No: 79562 germ=IGHV1-2*02 seqid1=51.2 seqid3=50.8 thrd1=0.169 thrd3=0.131 divg=0.088 Nucleic acid sequence=SEQ ID NO: 689 Amino acid sequence=SEQ ID NO: 1389; Antibody Heavy Chain No: 26114 germ=IGHV1-2*02 seqid1=51.2 seqid3=50.8 thrd1=0.169 thrd3=0.131 divg=0.088 Nucleic acid sequence=SEQ ID NO: 690 Amino acid sequence=SEQ ID NO: 1390; Antibody Heavy Chain No: 66679 germ=IGHV1-2*02 seqid1=53.7 seqid3=50.8 thrd1=0.169 thrd3=0.162 divg=0.088 Nucleic acid sequence=SEQ ID NO: 691 Amino acid sequence=SEQ ID NO: 1391; Antibody Heavy Chain No: 65060 germ=IGHV1-2*02 seqid1=54.5 seqid3=53.1 thrd1=0.147 thrd3=0.136 divg=0.088 Nucleic acid sequence=SEQ ID NO: 692 Amino acid sequence=SEQ ID NO: 1392; Antibody Heavy Chain No: 21715 germ=IGHV1-2*02 seqid1=55.4 seqid3=53.8 thrd1=0.243 thrd3=0.131 divg=0.088 Nucleic acid sequence=SEQ ID NO: 693 Amino acid sequence=SEQ ID NO: 1393; Antibody Heavy Chain No: 81335 germ=IGHV1-2*02 seqid1=52.1 seqid3=48.5 thrd1=0.139 thrd3=0.109 divg=0.088 Nucleic acid sequence=SEQ ID NO: 694 Amino acid sequence=SEQ ID NO: 1394; Antibody Heavy Chain No: 19816 germ=IGHV1-2*02 seqid1=54.5 seqid3=53.1 thrd1=0.147 thrd3=0.136 divg=0.088 Nucleic acid sequence=SEQ ID NO: 695 Amino acid sequence=SEQ ID NO: 1395; Antibody Heavy Chain No: 21088 germ=IGHV1-2*02 seqid1=51.2 seqid3=50.8 thrd1=0.169 thrd3=0.131 divg=0.088 Nucleic acid sequence=SEQ ID NO: 696 Amino acid sequence=SEQ ID NO: 1396; Antibody Heavy Chain No: 20584 germ=IGHV1-2*02 seqid1=54.5 seqid3=53.1 thrd1=0.147 thrd3=0.136 divg=0.088 Nucleic acid sequence=SEQ ID NO: 697 Amino acid sequence=SEQ ID NO: 1397; Antibody Heavy Chain No: 55431 germ=IGHV1-2*02 seqid1=51.2 seqid3=50.8 thrd1=0.169 thrd3=0.131 divg=0.088 Nucleic acid sequence=SEQ ID NO: 698 Amino acid sequence=SEQ ID NO: 1398; Antibody Heavy Chain No: 27745 germ=IGHV1-2*02 seqid1=51.2 seqid3=51.5 thrd1=0.197 thrd3=0.286 divg=0.088 Nucleic acid sequence=SEQ ID NO: 699 Amino acid sequence=SEQ ID NO: 1399; Antibody Heavy Chain No: 27991 germ=IGHV1-2*02 seqid1=47.9 seqid3=46.2 thrd1=0.173 thrd3=0.137 divg=0.088 Nucleic acid sequence=SEQ ID NO: 700 Amino acid sequence=SEQ ID NO: 1400; Antibody Heavy Chain No: 53541 germ=IGHV1-2*02 seqid1=53.7 seqid3=50.8 thrd1=0.169 thrd3=0.162 divg=0.088 Nucleic acid sequence=SEQ ID NO: 701 Amino acid sequence=SEQ ID NO: 1401; Antibody Heavy Chain No: 15670 germ=IGHV1-2*02 seqid1=49.6 seqid3=50.0 thrd1=0.125 thrd3=0.170 divg=0.088 Nucleic acid sequence=SEQ ID NO: 702 Amino acid sequence=SEQ ID NO: 1402; Antibody Heavy Chain No: 46476 germ=IGHV1-2*02 seqid1=55.4 seqid3=53.1 thrd1=0.148 thrd3=0.136 divg=0.088 Nucleic acid sequence=SEQ ID NO: 703 Amino acid sequence=SEQ ID NO: 1403; Antibody Heavy Chain No: 41234 germ=IGHV1-2*02 seqid1=54.5 seqid3=50.8 thrd1=0.162 thrd3=0.120 divg=0.088 Nucleic acid sequence=SEQ ID NO: 704 Amino acid sequence=SEQ ID NO: 1404; Antibody Heavy Chain No: 26766 germ=IGHV1-2*02 seqid1=52.1 seqid3=48.5 thrd1=0.139 thrd3=0.109 divg=0.088 Nucleic acid sequence=SEQ ID NO: 705 Amino acid sequence=SEQ ID NO: 1405; Antibody Heavy Chain No: 34607 germ=IGHV1-2*02 seqid1=50.4 seqid3=46.2 thrd1=0.177 thrd3=0.095 divg=0.088 Nucleic acid sequence=SEQ ID NO: 706 Amino acid sequence=SEQ ID NO: 1406; Antibody Heavy Chain No: 38262 germ=IGHV1-2*02 seqid1=51.2 seqid3=50.0 thrd1=0.153 thrd3=0.176 divg=0.088 Nucleic acid sequence=SEQ ID NO: 707 Amino acid sequence=SEQ ID NO: 1407; Antibody Heavy Chain No: 2032 germ=IGHV1-2*02 seqid1=51.2 seqid3=50.8 thrd1=0.169 thrd3=0.131 divg=0.088 Nucleic acid sequence=SEQ ID NO: 708 Amino acid sequence=SEQ ID NO: 1408; Antibody Heavy Chain No: 133700 germ=IGHV1-2*02 seqid1=52.9 seqid3=50.0 thrd1=0.195 thrd3=0.162 divg=0.088 Nucleic acid sequence=SEQ ID NO: 709 Amino acid sequence=SEQ ID NO: 1409; Antibody Heavy Chain No: 36987 germ=IGHV1-2*02 seqid1=54.5 seqid3=53.1 thrd1=0.147 thrd3=0.136 divg=0.088 Nucleic acid sequence=SEQ ID NO: 710 Amino acid sequence=SEQ ID NO: 1410; Antibody Heavy Chain No: 36221 germ=IGHV1-2*02 seqid1=48.8 seqid3=48.5 thrd1=0.160 thrd3=0.166 divg=0.088 Nucleic acid sequence=SEQ ID NO: 711 Amino acid sequence=SEQ ID NO: 1411; Antibody Heavy Chain No: 24266 germ=IGHV1-2*02 seqid1=54.5 seqid3=53.1 thrd1=0.147 thrd3=0.136 divg=0.088 Nucleic acid sequence=SEQ ID NO: 712 Amino acid sequence=SEQ ID NO: 1412; Antibody Heavy Chain No: 51353 germ=IGHV1-2*02 seqid1=51.2 seqid3=50.8 thrd1=0.166 thrd3=0.186 divg=0.088 Nucleic acid sequence=SEQ ID NO: 713 Amino acid sequence=SEQ ID NO: 1413; Antibody Heavy Chain No: 59427 germ=IGHV1-2*02 seqid1=51.2 seqid3=47.7 thrd1=0.140 thrd3=0.110 divg=0.088 Nucleic acid sequence=SEQ ID NO: 714 Amino acid sequence=SEQ ID NO: 1414; Antibody Heavy Chain No: 9160 germ=IGHV1-2*02 seqid1=50.4 seqid3=47.7 thrd1=0.165 thrd3=0.138 divg=0.088 Nucleic acid sequence=SEQ ID NO: 715 Amino acid sequence=SEQ ID NO: 1415; Antibody Heavy Chain No: 113616 germ=IGHV1-2*02 seqid1=29.8 seqid3=36.9 thrd1=0.366 thrd3=0.302 divg=0.088 Nucleic acid sequence=SEQ ID NO: 716 Amino acid sequence=SEQ ID NO: 1416; Antibody Heavy Chain No: 20929 germ=IGHV1-24*01 seqid1=47.9 seqid3=47.7 thrd1=0.203 thrd3=0.175 divg=0.088 Nucleic acid sequence=SEQ ID NO: 717 Amino acid sequence=SEQ ID NO: 1417; Antibody Heavy Chain No: 108561 germ=IGHV1-2*02 seqid1=51.2 seqid3=48.5 thrd1=0.142 thrd3=0.108 divg=0.084 Nucleic acid sequence=SEQ ID NO: 718 Amino acid sequence=SEQ ID NO: 1418; Antibody Heavy Chain No: 10295 germ=IGHV1-24*01 seqid1=47.9 seqid3=46.9 thrd1=0.215 thrd3=0.184 divg=0.084 Nucleic acid sequence=SEQ ID NO: 719 Amino acid sequence=SEQ ID NO: 1419; Antibody Heavy Chain No: 5982 germ=IGHV1-2*02 seqid1=56.2 seqid3=50.0 thrd1=0.198 thrd3=0.148 divg=0.084 Nucleic acid sequence=SEQ ID NO: 720 Amino acid sequence=SEQ ID NO: 1420; Antibody Heavy Chain No: 102928 germ=IGHV1-2*02 seqid1=53.7 seqid3=51.5 thrd1=0.170 thrd3=0.182 divg=0.084 Nucleic acid sequence=SEQ ID NO: 721 Amino acid sequence=SEQ ID NO: 1421; Antibody Heavy Chain No: 63623 germ=IGHV1-2*02 seqid1=52.9 seqid3=48.5 thrd1=0.171 thrd3=0.177 divg=0.084 Nucleic acid sequence=SEQ ID NO: 722 Amino acid sequence=SEQ ID NO: 1422; Antibody Heavy Chain No: 20898 germ=IGHV1-2*02 seqid1=52.9 seqid3=51.5 thrd1=0.153 thrd3=0.159 divg=0.084 Nucleic acid sequence=SEQ ID NO: 723 Amino acid sequence=SEQ ID NO: 1423; Antibody Heavy Chain No: 55760 germ=IGHV1-24*01 seqid1=47.1 seqid3=47.7 thrd1=0.194 thrd3=0.153 divg=0.084 Nucleic acid sequence=SEQ ID NO: 724 Amino acid sequence=SEQ ID NO: 1424; Antibody Heavy Chain No: 43527 germ=IGHV1-2*02 seqid1=47.9 seqid3=47.7 thrd1=0.143 thrd3=0.132 divg=0.084 Nucleic acid sequence=SEQ ID NO: 725 Amino acid sequence=SEQ ID NO: 1425; Antibody Heavy Chain No: 82760 germ=IGHV1-2*02 seqid1=53.7 seqid3=51.5 thrd1=0.170 thrd3=0.182 divg=0.084 Nucleic acid sequence=SEQ ID NO: 726 Amino acid sequence=SEQ ID NO: 1426; Antibody Heavy Chain No: 46807 germ=IGHV1-2*02 seqid1=53.7 seqid3=52.3 thrd1=0.243 thrd3=0.131 divg=0.084 Nucleic acid sequence=SEQ ID NO: 727 Amino acid sequence=SEQ ID NO: 1427; Antibody Heavy Chain No: 17702 germ=IGHV1-2*02 seqid1=52.9 seqid3=48.5 thrd1=0.129 thrd3=0.165 divg=0.084 Nucleic acid sequence=SEQ ID NO: 728 Amino acid sequence=SEQ ID NO: 1428; Antibody Heavy Chain No: 83355 germ=IGHV1-2*02 seqid1=50.4 seqid3=46.9 thrd1=0.148 thrd3=0.127 divg=0.084 Nucleic acid sequence=SEQ ID NO: 729 Amino acid sequence=SEQ ID NO: 1429; Antibody Heavy Chain No: 94471 germ=IGHV1-2*02 seqid1=52.1 seqid3=50.8 thrd1=0.171 thrd3=0.084 divg=0.084 Nucleic acid sequence=SEQ ID NO: 730 Amino acid sequence=SEQ ID NO: 1430; Antibody Heavy Chain No: 8425 germ=IGHV1-2*02 seqid1=52.9 seqid3=48.5 thrd1=0.170 thrd3=0.137 divg=0.084 Nucleic acid sequence=SEQ ID NO: 731 Amino acid sequence=SEQ ID NO: 1431; Antibody Heavy Chain No: 54065 germ=IGHV1-2*02 seqid1=46.3 seqid3=44.6 thrd1=0.205 thrd3=0.131 divg=0.084 Nucleic acid sequence=SEQ ID NO: 732 Amino acid sequence=SEQ ID NO: 1432; Antibody Heavy Chain No: 154038 germ=IGHV1-2*02 seqid1=51.2 seqid3=48.5 thrd1=0.257 thrd3=0.285 divg=0.084 Nucleic acid sequence=SEQ ID NO: 733 Amino acid sequence=SEQ ID NO: 1433; Antibody Heavy Chain No: 31030 germ=IGHV1-2*02 seqid1=52.1 seqid3=47.7 thrd1=0.172 thrd3=0.167 divg=0.084 Nucleic acid sequence=SEQ ID NO: 734 Amino acid sequence=SEQ ID NO: 1434; Antibody Heavy Chain No: 6964 germ=IGHV1-2*02 seqid1=51.2 seqid3=51.5 thrd1=0.140 thrd3=0.136 divg=0.084 Nucleic acid sequence=SEQ ID NO: 735 Amino acid sequence=SEQ ID NO: 1435; Antibody Heavy Chain No: 94801 germ=IGHV1-2*02 seqid1=54.5 seqid3=51.5 thrd1=0.167 thrd3=0.209 divg=0.084 Nucleic acid sequence=SEQ ID NO: 736 Amino acid sequence=SEQ ID NO: 1436; Antibody Heavy Chain No: 54498 germ=IGHV1-2*02 seqid1=54.5 seqid3=52.3 thrd1=0.166 thrd3=0.208 divg=0.084 Nucleic acid sequence=SEQ ID NO: 737 Amino acid sequence=SEQ ID NO: 1437; Antibody Heavy Chain No: 181191 germ=IGHV1-2*02 seqid1=49.6 seqid3=50.0 thrd1=0.139 thrd3=0.123 divg=0.084 Nucleic acid sequence=SEQ ID NO: 738 Amino acid sequence=SEQ ID NO: 1438; Antibody Heavy Chain No: 29619 germ=IGHV1-2*02 seqid1=50.4 seqid3=48.5 thrd1=0.144 thrd3=0.114 divg=0.084 Nucleic acid sequence=SEQ ID NO: 739 Amino acid sequence=SEQ ID NO: 1439; Antibody Heavy Chain No: 138957 germ=IGHV1-2*02 seqid1=52.1 seqid3=53.8 thrd1=0.173 thrd3=0.143 divg=0.084 Nucleic acid sequence=SEQ ID NO: 740 Amino acid sequence=SEQ ID NO: 1440; Antibody Heavy Chain No: 27733 germ=IGHV1-2*02 seqid1=52.9 seqid3=52.3 thrd1=0.137 thrd3=0.219 divg=0.081 Nucleic acid sequence=SEQ ID NO: 741 Amino acid sequence=SEQ ID NO: 1441; Antibody Heavy Chain No: 54867 germ=IGHV1-2*02 seqid1=54.5 seqid3=50.8 thrd1=0.169 thrd3=0.212 divg=0.081 Nucleic acid sequence=SEQ ID NO: 742 Amino acid sequence=SEQ ID NO: 1442; Antibody Heavy Chain No: 15769 germ=IGHV1-2*02 seqid1=54.5 seqid3=52.3 thrd1=0.169 thrd3=0.126 divg=0.081 Nucleic acid sequence=SEQ ID NO: 743 Amino acid sequence=SEQ ID NO: 1443; Antibody Heavy Chain No: 23105 germ=IGHV1-2*02 seqid1=53.7 seqid3=51.5 thrd1=0.171 thrd3=0.123 divg=0.081 Nucleic acid sequence=SEQ ID NO: 744 Amino acid sequence=SEQ ID NO: 1444; Antibody Heavy Chain No: 61167 germ=IGHV1-2*02 seqid1=53.7 seqid3=50.8 thrd1=0.170 thrd3=0.163 divg=0.081 Nucleic acid sequence=SEQ ID NO: 745 Amino acid sequence=SEQ ID NO: 1445; Antibody Heavy Chain No: 57037 germ=IGHV1-2*02 seqid1=54.5 seqid3=50.8 thrd1=0.169 thrd3=0.212 divg=0.081 Nucleic acid sequence=SEQ ID NO: 746 Amino acid sequence=SEQ ID NO: 1446; Antibody Heavy Chain No: 20299 germ=IGHV1-2*02 seqid1=53.7 seqid3=52.3 thrd1=0.217 thrd3=0.149 divg=0.081 Nucleic acid sequence=SEQ ID NO: 747 Amino acid sequence=SEQ ID NO: 1447; Antibody Heavy Chain No: 19870 germ=IGHV1-2*02 seqid1=53.7 seqid3=52.3 thrd1=0.151 thrd3=0.210 divg=0.081 Nucleic acid sequence=SEQ ID NO: 748 Amino acid sequence=SEQ ID NO: 1448; Antibody Heavy Chain No: 61564 germ=IGHV1-2*02 seqid1=50.4 seqid3=48.5 thrd1=0.238 thrd3=0.134 divg=0.081 Nucleic acid sequence=SEQ ID NO: 749 Amino acid sequence=SEQ ID NO: 1449; Antibody Heavy Chain No: 58649 germ=IGHV1-2*02 seqid1=54.5 seqid3=50.8 thrd1=0.169 thrd3=0.212 divg=0.081 Nucleic acid sequence=SEQ ID NO: 750 Amino acid sequence=SEQ ID NO: 1450; Antibody Heavy Chain No: 106478 germ=IGHV1-2*02 seqid1=49.6 seqid3=48.5 thrd1=0.152 thrd3=0.163 divg=0.081 Nucleic acid sequence=SEQ ID NO: 751 Amino acid sequence=SEQ ID NO: 1451; Antibody Heavy Chain No: 50598 germ=IGHV1-2*02 seqid1=48.8 seqid3=48.5 thrd1=0.202 thrd3=0.106 divg=0.081 Nucleic acid sequence=SEQ ID NO: 752 Amino acid sequence=SEQ ID NO: 1452; Antibody Heavy Chain No: 121214 germ=IGHV1-2*02 seqid1=51.2 seqid3=50.8 thrd1=0.203 thrd3=0.199 divg=0.081 Nucleic acid sequence=SEQ ID NO: 753 Amino acid sequence=SEQ ID NO: 1453; Antibody Heavy Chain No: 61758 germ=IGHV1-2*02 seqid1=52.9 seqid3=51.5 thrd1=0.116 thrd3=0.124 divg=0.081 Nucleic acid sequence=SEQ ID NO: 754 Amino acid sequence=SEQ ID NO: 1454; Antibody Heavy Chain No: 128584 germ=IGHV1-2*02 seqid1=46.3 seqid3=45.4 thrd1=0.153 thrd3=0.159 divg=0.081 Nucleic acid sequence=SEQ ID NO: 755 Amino acid sequence=SEQ ID NO: 1455; Antibody Heavy Chain No: 16992 germ=IGHV1-2*02 seqid1=52.1 seqid3=48.5 thrd1=0.138 thrd3=0.150 divg=0.081 Nucleic acid sequence=SEQ ID NO: 756 Amino acid sequence=SEQ ID NO: 1456; Antibody Heavy Chain No: 42053 germ=IGHV1-2*02 seqid1=52.1 seqid3=48.5 thrd1=0.185 thrd3=0.170 divg=0.081 Nucleic acid sequence=SEQ ID NO: 757 Amino acid sequence=SEQ ID NO: 1457; Antibody Heavy Chain No: 41974 germ=IGHV1-2*02 seqid1=45.5 seqid3=46.2 thrd1=0.169 thrd3=0.220 divg=0.081 Nucleic acid sequence=SEQ ID NO: 758 Amino acid sequence=SEQ ID NO: 1458; Antibody Heavy Chain No: 8314 germ=IGHV1-2*02 seqid1=49.6 seqid3=47.7 thrd1=0.135 thrd3=0.114 divg=0.081 Nucleic acid sequence=SEQ ID NO: 759 Amino acid sequence=SEQ ID NO: 1459.

Example 5

Creation of VRC01 and VRC01 Like Multimeric Antibodies

As disclosed herein VRC01, a broadly neutralizing human IgG1 monoclonal antibody against HIV, was cloned from human B cells obtained from an HIV infected donor. VRC01 IgG1 was shown to have very potent neutralization activity against more than 90% of HIV isolates from all clades. This makes it an attractive therapeutic candidate, and a subject for extensive studies aiming to understand the nature of the antigenic stimuli needed to generate VRC01-like antibodies by infection or immunization. This example describes the characterization and development of an IgM antibody carrying the VRC01 V region. We also compare its neutralizing activity against HIV with that of the originally isolated VRC01 IgG1 (see FIG. 92).

The VRC01 V region was cloned into an expression vector containing the constant region from the m chain. The IgM was then produced in 293F cells transiently transfected with this plasmid along with two other plasmids that encoded the VRC01 k light chain and the human J chain, respectively. The IgM was purified by FPLC using a HiTrap IgM column and a Superose-6 size exclusion column.

Secreted pentameric IgM antibodies carrying the VRC01 V region were purified to homogeneity by IgM affinity chromatography followed by size exclusion chromatography. On a molar basis comparison with the VRCO1-IgG, the IgM antibody has increased in vitro neutralizing activity against a panel of VRC01-sensitive and resistant HIV virus strains.

In view of the many possible embodiments to which the principles of our invention may be applied, it should be recognized that illustrated embodiments are only examples of the invention and should not be considered a limitation on the scope of the invention. Rather, the scope of the invention is defined by the following claims. We therefore claim as our invention all that comes within the scope and spirit of these claims.

SEQUENCE LISTING (1459 sequences)

SEQ ID NO: 1 - protein, 122 aa, Homo sapiens
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSP

SEQ ID NO: 2 - protein, 104 aa, Homo sapiens
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKR

SEQ ID NO: 3 - protein, 122 aa, Homo sapiens
QVQLVQSGGQMKKPGESMRISCQASGYEFIDCTLNWVRLAPGRRPEWMGWLKPRGGAVNYARPLQGRVTMTRDVYSDTAFLELRSLTADDTAVYYCTRGKNCDYNWDFEHWGRGTPVTVSSA

SEQ ID NO: 4 - protein, 104 aa, Homo sapiens
EIVLTQSPGTLSLSPGETAIISCRTSQYGSLAWYQQRPGQAPRLVIYSGSTRAAGIPDRFSGSRWGPDYNLTIRNLESGDFGLYYCQQYEFFGQGTKVQVDIKR

SEQ ID NO: 5 - protein, 462 aa, Homo sapiens
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLFGVPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - protein, 462 aa, Homo sapiens
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTWFGVPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7 - protein, 462 aa, Homo sapiens
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLWGVPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8 - protein, 462 aa, Homo sapiens
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLFGWPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9 - protein, 462 aa, Homo sapiens
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTWFGWPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - protein, 214 aa, Homo sapiens
ALQLTQSPSSLSASVGDRITITCRASQGVTSALAWYRQKPGSPPQLLIYDASSLESGVPSRFSGSGSGTEFTLTISTLRPEDFATYYCQQLHFYPHTFGGGTRVDVRRTVAAPSVFIFPPSDEQLKSGTASVVCLLNNFYPREAKVQWKVDNALQSGNSQESVTEQDSKDSTYSLSSTLTLSKADYEKHKVYECEVTHQGLSSPVTKSFNRGEC

SEQ ID NO: 11 - protein, 297 aa, Human Immunodeficiency Virus
EVLEADKWAILGATKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPANLSIFTVGGPRVGNPTFAYYVESTGIPFARTVHKRDIVPHVPPQSFGFLHPGVESWIKSGTSNVQVCGSAIETKDCSNSIVPFTSILDHLSYFDINEGSCLSGLVPRGSGSHHHHHHGGLNDIFEAQKIEWHE

SEQ ID NO: 12 - protein, 297 aa, Human Immunodeficiency Virus
EVLEADEWAILGATKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPANLSIFTVGGPRVGNPTFAYYVESTGIPFARTVHKRDIVPHVPPQSFGFLHPGVESWIKSGTSNVQVCGSAIETKDCSNSIVPFTSILDHLSYFDINEGSCLSGLVPRGSGSHHHHHHGGLNDIFEAQKIEWHE

SEQ ID NO: 13 - protein, 297 aa, Human Immunodeficiency Virus
EVLALDSWKNLGATKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPANLSIFTVGGPRVGNPTFAYYVESTGIPFARTVHKRDIVPHVPPQSFGFLHPGVESWIKSGTSNVQVCGSAIETKDCSNSIVPFTSILDHLSYFDINEGSCLSGLVPRGSGSHHHHHHGGLNDIFEAQKIEWHE

SEQ ID NO: 14 - protein, 212 aa, Human Immunodeficiency Virus
ASDPVRQYLHEIGEVLELDKWAELGAAAKVEEGMEAIKKLSEATGLDQELIREVVRAKILGTAAIQKIPGLKEKPDPKTVEEVDGKLKSLPKELKRYLHIAREGEAARQHLIEANLRLVVSIAKKYTGRGLSFLDLIQEGNQGLIRAVEKFEYKRGFAFSTYATWWIRQAINRAIADQARSGLVPRGSGSHHHHHHGGLNDIFEAQKIEWHE

SEQ ID NO: 15 - protein, 212 aa, Human Immunodeficiency Virus
ASDPVRQYLHEIGEVLELDEWAELGAAAKVEEGMEAIKKLSEATGLDQELIREVVRAKILGTAAIQKIPGLKEKPDPKTVEEVDGKLKSLPKELKRYLHIAREGEAARQHLIEANLRLVVSIAKKYTGRGLSFLDLIQEGNQGLIRAVEKFEYKRGFAFSTYATWWIRQAINRAIADQARSGLVPRGSGSHHHHHHGGLNDIFEAQKIEWHE

SEQ ID NO: 16 - protein, 212 aa, Human Immunodeficiency Virus
ASDPVRQYLHEIGEVLALDSWKNLGAAAKVEEGMEAIKKLSEATGLDQELIREVVRAKILGTAAIQKIPGLKEKPDPKTVEEVDGKLKSLPKELKRYLHIAREGEAARQHLIEANLRLVVSIAKKYTGRGLSFLDLIQEGNQGLIRAVEKFEYKRGFAFSTYATWWIRQAINRAIADQARSGLVPRGSGSHHHHHHGGLNDIFEAQKIEWHE

SEQ ID NO: 17 - protein, 294 aa, Human Immunodeficiency Virus
EILELDKWAILGMRVAGRLAAEVLEMIEPYVKPGVSTGELDRICNDYIVNEQHAVSACLGYHGYPKSVCISINEVVCHGIPDDAKLLKDGDIVNIDVTVIKAGAHGDTSKMFIVGKPTIMGERLCRITQESLYLALRMVKPGINLREIGAAIQKFVEAEGFSVVREYCGHGIGGGFHEEPQVLHYDSRETNVVLKPGMTFTIEPMVNAGKKEIRTMKDGWTVKTKDRSLSAQYEHTIVVTDNGCEILTLRKDDTIPAIISHDSGLVPRGSGSHHHHHHGGLNDIFEAQKIEWHE

SEQ ID NO: 18 - protein, 294 aa, Human Immunodeficiency Virus
EILELDEWAILGMRVAGRLAAEVLEMIEPYVKPGVSTGELDRICNDYIVNEQHAVSACLGYHGYPKSVCISINEVVCHGIPDDAKLLKDGDIVNIDVTVIKAGAHGDTSKMFIVGKPTIMGERLCRITQESLYLALRMVKPGINLREIGAAIQKFVEAEGFSVVREYCGHGIGGGFHEEPQVLHYDSRETNVVLKPGMTFTIEPMVNAGKKEIRTMKDGWTVKTKDRSLSAQYEHTIVVTDNGCEILTLRKDDTIPAIISHDSGLVPRGSGSHHHHHHGGLNDIFEAQKIEWHE

SEQ ID NO: 19 - protein, 294 aa, Human Immunodeficiency Virus
EILALDSWKNLGMRVAGRLAAEVLEMIEPYVKPGVSTGELDRICNDYIVNEQHAVSACLGYHGYPKSVCISINEVVCHGIPDDAKLLKDGDIVNIDVTVIKAGAHGDTSKMFIVGKPTIMGERLCRITQESLYLALRMVKPGINLREIGAAIQKFVEAEGFSVVREYCGHGIGGGFHEEPQVLHYDSRETNVVLKPGMTFTIEPMVNAGKKEIRTMKDGWTVKTKDRSLSAQYEHTIVVTDNGCEILTLRKDDTIPAIISHDSGLVPRGSGSHHHHHHGGLNDIFEAQKIEWHE

SEQ ID NO: 20 - protein, 209 aa, Human Immunodeficiency Virus
DAASDLKSRLDKVSSFGAGFTQKVTDVQEGQGALAVKRPNLFAWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKAQENLEVDKWAFLFGPPQGVTVDDQRKSGLVPRGSGSHHHHHHGGLNDIFEAQKIEWHE

SEQ ID NO: 21 - protein, 209 aa, Human Immunodeficiency Virus
DAASDLKSRLDKVSSFGAGFTQKVTDVQEGQGALAVKRPNLFAWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKAQENLEVDEWAFLFGPPQGVTVDDQRKSGLVPRGSGSHHHHHHGGLNDIFEAQKIEWHE

SEQ ID NO: 22 - protein, 209 aa, Human Immunodeficiency Virus
DAASDLKSRLDKVSSFGAGFTQKVTDVQEGQGALAVKRPNLFAWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKAQENLAVDSWKNLFGPPQGVTVDDQRKSGLVPRGSGSHHHHHHGGLNDIFEAQKIEWHE

SEQ ID NO: 23 - protein, 113 aa, Human Immunodeficiency Virus
SKMLQHIDYRMRCIGGAGGIAIGTFKAFGAGMGLILCDCDAFAKIKPKNSKQAEREEKAVGELLELDKWALLSMTVEGPPPSGLVPRGSGSHHHHHHGGLNDIFEAQKIEWHE

SEQ ID NO: 24 - protein, 113 aa, Human Immunodeficiency Virus
SKMLQHIDYRMRCIGGAGGIAIGTFKAFGAGMGLILCDCDAFAKIKPKNSKQAEREEKAVGELLELDEWALLSMTVEGPPPSGLVPRGSGSHHHHHHGGLNDIFEAQKIEWHE

SEQ ID NO: 25 - protein, 113 aa, Human Immunodeficiency Virus
SKMLQHIDYRMRCIGGAGGIAIGTFKAFGAGMGLILCDCDAFAKIKPKNSKQAEREEKAVGELLALDSWKNLSMTVEGPPPSGLVPRGSGSHHHHHHGGLNDIFEAQKIEWHE

SEQ ID NO: 26 - protein, 14 aa, Human Immunodeficiency Virus
LNDIFEAQKIEWHE

SEQ ID NO: 27 - protein, 130 aa, Homo sapiens
QVQLVQSGAVIKTPGSSVKISCRASGYNFRDYSIHWVRLIPDKGFEWIGWIKPLWGAVSYARQLQGRVSMTRQLSQDPDDPDWGVAYMEFSGLTSPADTAEYFCVRRGSCDYCGDFPWQYWGQGTWWSSA

SEQ ID NO: 28 - protein, 102 aa, Homo sapiens
EIVLTQSPGILSLSPGETATLFCKASQGGNAMTWYQKRRGQVPRLLIYDTSRRASGVPDRFVGSGSGTDFFLTINKLDREDFAVYYCQQFEFFGLGSELEVH

SEQ ID NO: 29 - DNA, 365 bp, Homo sapiens
caggtgcagctggtgcagtctgggggtcagatgaagaagcctggcgagtcgatgagaatttcttgtcgggcttctggatatgaatttattgattgtacgctaaattggattcgtctggcccccggaaaaaggcctgagtggatgggatggctgaagcctcgggggggggccgtcaactacgcacgtccacttcagggcagagtgaccatgactcgagacgtttattccgacacagcctttttggagctgcgctcgttgacagtagacgacacggccgtctacttttgtactaggggaaaaaactgtgattacaattgggacttcgaacactggggccggggcaccccggtcatcgtctcatcacc

SEQ ID NO: 30 - DNA, 312 bp, Homo sapiens
gaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaatctcaccatcagcaacctggagtcgggagattttggtgtttattattgccagcagtatgaattttttggccaggggaccaaggtccaggtcgacattaagcga

SEQ ID NO: 31 - DNA, 366 bp, Homo sapiens
caggtgcagctggtgcagtctgggggccagatgaagaagcctggcgagtcgatgagaatttcttgtcaggcttccggatatgaatttattgattgtacactaaattgggttcgcctggcccccggaagaaggcctgaatggatgggatggctgaagcctcgagggggggccgtcaactacgcacgtccacttcaaggcagagtgaccatgactcgagacgtgtattccgacacagcctttttggagctgcgctccttgacagcagacgacacggccgtctactattgtactaggggaaaaaattgtgattacaattgggacttcgaacactggggccggggtaccccggtcaccgtctcatcagcc

SEQ ID NO: 32 - DNA, 312 bp, Homo sapiens
gaaattgtgttgacacagtctccaggcaccctgtctttgtctccaggggaaacagccatcatctcttgtcggaccagtcagtatggttccttagcctggtatcaacagaggcccggccaggccccccggctcgtcatctattcgggctctactcgggccgcaggcatcccagacaggttcagcggcagtcggtgggggccagactacaatctcaccatcaggaacctggagtcgggagattttggtctttattattgccagcagtatgaattttttggccaggggaccaaggtccaggtcgacattaagcga

SEQ ID NO: 33 - DNA, 394 bp, Homo sapiens
caggtgcagctggtgcagtctggggctgtgattaagacgcctgggtcctcagtgaagatctcatgtcgggcttctggatacaactttcgtgattattcgatccattgggtccgcctcattcctgacaagggatttgagtggattggatggattaaacctctgtggggtgccgtcagttatgcccggcaacttcagggccgagtctctatgactcgacaattatctcaagacccagacgacccggactggggcgttgcctacatggagttcagtggactgacgtcccgccgacacggccgaatatttttgtgtccggagagggtcctgtgattattgcggagactttccctggcaatactggggtcagggcaccgtcgtcgtcgtctcgtcagcg

SEQ ID NO: 34 - DNA, 309 bp, Homo sapiens
gaaattgtgttgacgcagtctcccggcatcctgtctctgtctccaggagagacagccaccctcttttgtaaggccagtcagggtggcaatgctatgacgtggtatcagaagagacgtggccaggttcccagactcctgatctacgatacatctcgcagggcctctggcgttcctgacagatttgttggcagtgggtctgggacagacttctttctcacgatcaacaaattggaccgggaagatttcgcagtctattattgtcaacaatttgaattttttggcctggggagcgagctggaagtccatcga

SEQ ID NO: 35 - protein, 1483 aa, Artificial sequence
  Recombinant nucleic acid product.
ATGGGATGGTCATGTATCATCCTTTTTCTAGTAGCAACTGCAACCGGTGTACATTCCCAGGTGCAGCTGGTGCAGTCTGGAGGTCAGATGAAGAAGCCTGGCGAGTCGATGAGAATTTCTTGTCGGGCTTCTGGATATGAATTTATTGATTGTACGCTAAATTGGATTCGTCTGGCCCCCGGAAAAAGGCCTGAGTGGATGGGATGGCTGAAGCCTCGGGGGGGGGCCGTCAACTACGCACGTCCACTTCAGGGCAGAGTGACCATGACTCGAGACGTTTATTCCGACACAGCCTTTTTGGAGCTGCGCTCGTTGACAGTAGACGACACGGCCGTCTACTTTTGTACTAGGGGAAAAAACTGTGATTACAATTGGGACTTCGAACACTGGGGCCGGGGCACCCCGGTCATCGTCTCATCAGGAGGGGGAAGCGGAGGGGGAAGCGGAGGGGGAAGCGGAGGGGGATCCGAAATTGTGTTGACACAGTCTCCAGGCACCCTGTCTTTGTCTCCAGGGGAAACAGCCATCATCTCTTGTCGGACCAGTCAGTATGGTTCCTTAGCCTGGTATCAACAGAGGCCCGGCCAGGCCCCCAGGCTCGTCATCTATTCGGGCTCTACTCGGGCCGCTGGCATCCCAGACAGGTTCAGCGGCAGTCGGTGGGGGCCAGACTACAATCTCACCATCAGCAACCTGGAGTCGGGAGATTTTGGTGTTTATTATTGCCAGCAGTATGAATTTTTTGGCCAGGGGACCAAGGTCCAGGTCGACATTAAAGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGATGAGCTGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAAATGA

SEQ ID NO: 36 - protein, 19 aa, Human Immunodeficiency Virus
MYSMQLASCVTLTLVLLVN

SEQ ID NO: 37 - protein, 78 aa, Human Immunodeficiency Virus
PLCVTLHCTTAKLTNVTNITNVPNIGNITDEVRNCSFNMTTEIRDKKQKVHALFYKLDIVQIEDKNDSSKYRLINCNT

SEQ ID NO: 38 - protein, 21 aa, Human Immunodeficiency Virus
NMRTSMRIGPGQVFYRTGSIT

SEQ ID NO: 39 - protein, 6 aa, Artificial sequence
  Linker peptide
GGSGSG

SEQ ID NO: 40 - protein, 23 aa, Human Immunodeficiency Virus
QELLELDKWASLGGTETSQVAPA

SEQ ID NO: 41 - protein, 119 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYVWAEYFQHWGQGTLVTVSS

SEQ ID NO: 42 - protein, 101 aa, Homo sapiens
EIVLTQSPATLSLSPGERATLSCRASQYSVSSYLAWYQQKPGQAPRLLIYDASNRATGIPARFSGSGSGRDFTLTISSLEPEDFAVYYCQQFGQGTKLEIK

SEQ ID NO: 43 - protein, 96 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSP

SEQ ID NO: 44 - protein, 353 aa, Homo sapiens [sequence omitted]

SEQ ID NO: 45 - protein, 355 aa, Homo sapiens
VWKEATTTLFCASDAKAYDTEVHNVWATHACVPTDPNPQEVVLVNVTENFNMWKNDMVEQMHEDIISLWDQSLKPCVKLTPLCVGAGSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTGAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIE

SEQ ID NO: 46 - protein, 46 aa, Homo sapiens
SNTTGILLTRDGGANNTSNETFRPGGGNIKDNWRSELYKYKVVQIE

SEQ ID NO: 47 - protein, 6 aa, Artificial sequence
  Recombinant peptide product.
LFGVPI

SEQ ID NO: 48 - protein, 6 aa, Artificial sequence
  Recombinant peptide product.
SFGVPI

SEQ ID NO: 49 - protein, 6 aa, Artificial sequence
  Recombinant product.
LSGVPI

SEQ ID NO: 50 - protein, 6 aa, Artificial sequence
  Recombinant product.
LFGSPI

SEQ ID NO: 51 - protein, 6 aa, Artificial sequence
  Recombinant product.
LFGVPS

SEQ ID NO: 52 - protein, 6 aa, Artificial sequence
  Recombinant product.
SSGVPI

SEQ ID NO: 53 - protein, 6 aa, Artificial sequence
  Recombinant product.
SFGSPI

SEQ ID NO: 54 - protein, 6 aa, Artificial sequence
  Recombinant product.
LSGVPS

SEQ ID NO: 55 - protein, 6 aa, Artificial sequence
  Recombinant product.
WFGVPI

SEQ ID NO: 56 - protein, 6 aa, Artificial sequence
  Recombinant product.
LWGVPI

SEQ ID NO: 57 - protein, 6 aa, Artificial sequence
  Recombinant product.
LFGWPI

SEQ ID NO: 58 - protein, 6 aa, Artificial sequence
  Recombinant product.
WFGWPI

SEQ ID NO: 59 - protein, 1478 aa, Artificial sequence
  Recombinant nucleic acid product.
ATGGGATGGTCATGTATCATCCTTTTTCTAGTAGCAACTGCAACCGGTGTACATTCAGAAATTGTGTTGACACAGTCTCCAGGCACCCTGTCTTTGTCTCCAGGGGAAACAGCCATCATCTCTTGTCGGACCAGTCAGTATGGTTCCTTAGCCTGGTATCAACAGAGGCCCGGCCAGGCCCCCAGGCTCGTCATCTATTCGGGCTCTACTCGGGCCGCTGGCATCCCAGACAGGTTCAGCGGCAGTCGGTGGGGGCCAGACTACAATCTCACCATCAGCAACCTGGAGTCGGGAGATTTTGGTGTTTATTATTGCCAGCAGTATGAATTTTTTGGCCAGGGGACCAAGGTCGACATTAAAGGAGGGGGAAGCGGAGGGGGAAGCGGAGGGGGAAGCGGAGGGGGATCCCCAGGTGCAGCTGGTGCAGTCTGGAGGTCAGATGAAGAAGCCTGGCGAGTCGATGAGAATTTCTTGTCGGGCTTCTGGATATGAATTTATTGATTGTACGCTAAATTGGATTCGTCTGGCCCCCGGAAAAAGGCCTGAGTGGATGGGATGGCTGAAGCCTCGGGGGGGGGCCGTCAACTACGCACGTCCACTTCAGGGCAGAGTGACCATGACTCGAGACGTTTATTCCGACACAGCCTTTTTGGAGCTGCGCTCGTTGACAGTAGACGACACGGCCGTCTACTTTTGTACTAGGGGAAAAAACTGTGATTACAATTGGGACTTCGAACACTGGGGCCGGGGCACCCCGGTCATCGTCTCATCAGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGATGAGCTGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAAATGA

SEQ ID NO: 60 - DNA, 369 bp, Homo sapiens
caggtgcagctggtgcagtctggggctgtgattaagacgcctgggtcctcagtgaagatctcatgtcgggcttctggatacaactttcgtgattattcgatccattgggtccgcctcattcctgacaagggatttgagtggattggatggattaaacctctgtggggtgccgtcagttatgcccggcaacttcagggccgagtctctatgactcgacaattatctcaagacccagacgacccggacgtgggcgttgcctacatggagttcagtggactgacgcccgccgacacggccgaatatttttgtgtccggagagggtcctgtgattattgcggagactttccctggcaatactggggtcagggc

SEQ ID NO: 61 - DNA, 440 bp, Homo sapiens
caggtgcagctggtgcagtctggggctgtgattaagacgcctgggtcctcagtgaagatctcatgtcgggcttctggatacaactttcgtgattattcgatccattgggtccgcctcattcctgacaagggatttgtgtggattggatggattaaacctctgtggggtgccgtcagttatgcccggcaacttcagggccgagtctctatgactcgacaattatctcaagacccagacgacccggactggggcgttgcctacatggagttcagtggactgacgcccgccgacacggccgaatatttttgtgtccggagagggtcctgtgattattgcggagactttccctggcaatactggggtcagggcaccgtcgtcgtcgtctcgtcagcgtcgaccaaggcccatcggtcttcccctggccaccctcctccaagacg

SEQ ID NO: 62 - DNA, 437 bp, Homo sapiens
  misc_feature (309)..(309): n is a, c, g, or t
caggtgcagctggtgcagtctggggctgtgattaagacgcctgggtcctcagtgaagatctcatgtcgggcttctggatacaactttcgtgattattcgatccattgggtccgcctcattcctgacaagggatttgagtggattggatggattaaacctctgtggggtgccgtcagttatgcccggcaacttcagggccgagtctctatgactcgacaattatctcaagacccagacgacccggactggggcgttgcctacatggagttcagtggactgacgcccgccgacacggccgaatatttttgngtccggagagggtcctgtgattattgcggagactttccctggcaatactggggtcagggcaccgtcgtcgtcgtctcgtcagcgccgaccaaggcccatcggtcttccccctggccaccctcctccaa

SEQ ID NO: 63 - DNA, 390 bp, Homo sapiens
caggtgcagctggtgcagtctggggctgtgattaagacgcctgggtcctcagtgaagatctcatgtcgggcttctggatacaactttcgtgattattcgatccattgggtccgcctcattcctgacaagggatttgagtggattggatggattaaacctctgtgtggtgccgtcagttatgcccggcaacttcagggccgagtctctatgactcgacaattatctcaagacccagacgacccggactggggcgttgcctacatggagttcagtggactgacgcccgccgacacggccgaatattttgtgtccggagagggtcctgtgattattgcggagactttccctggcaatacgtggggtcagggcaccgtcgtcgtcgtctcgtca

SEQ ID NO: 64 - DNA, 399 bp, Homo sapiens
caggtgcagctggtgcagtctggggctgtgattaagacgcctgggtcctcagtgaagatctcatgtcgggcttctggatacaactttcgtgattattcgatccattgggtccgcctcattcctgacaagggatttgagtggattggatggattaaacctctgtggggtgccgtcagttatgcccggcaacttcagggccgagtctctatgactcgacaattatctcaagacccagacgacccggactggggcgttgcctacatggagttcagtggactgacgcccgccgacacggccgaatatttttgtgtccggagagggtcctgtgattattgcggagactttccctggcaatactggggtcagggcaccgtcgtcgtcgtctcgtcagcgtcgacc

SEQ ID NO: 65 - DNA, 399 bp, Homo sapiens; identical to SEQ ID NO: 64

SEQ ID NO: 66 - DNA, 399 bp, Homo sapiens; identical to SEQ ID NO: 64

SEQ ID NO: 67 - DNA, 377 bp, Homo sapiens
caggtgcagctggtgcagtctgatgctgacctgaggaagcccggggcctcagtgaaggtctcctgtaaggcctctggatatatattcaaaaatcaatatatacactgggtgcgacaggcccctggacgagggtttgagtggatgggacatctcaacccttggagcgggggcacagtttatgcacagaagttccaggacaggctttccatgaccagggacatgtccacaagtacagcctatatggaattgaggagcttgacatctgacgacacggccaactacttttgtctcactgcaataattgatgtcgtctactggggccagggaacggtggtcaccgtctcctcagcctccaccaagggcccatcggtcttccc

SEQ ID NO: 68 - DNA, 367 bp, Homo sapiens
caggtgcagctggtgcagtctgggactgaagtgaagaagtctggggcctcactgaaaatctcctgtatgacagcaggatacactttcagcgcccactacattcactgggtgcgacaggcccctggacaaggccttgagtggatgggatggatcaaccctgccactggtgacacaaaatttgtccagacttttcaggggagacttgccatgacaagggacacgaccaccgacacggtcaacctgattttggccagtgtaaaaccgaatgacacggccacatattattgcgcgagagattggcagtttcaagtcacttttggcgacttttacatggacatctggggcaacgggaccacagtcatcgtct

SEQ ID NO: 69 - DNA, 402 bp, Homo sapiens
  misc_feature (306)..(306): n is a, c, g, or t
caggtgcagctggtgcagtctgatgctgacctgaggaaccccggggcctcagtgaaggtctcctgtaaggcctctggatatatattcaaaaatcaatatatacactgggtgcgacaggcccctggacaagggtttgagtggatgggacatctcaacccttggagcgggggcacagtttatgcacagaagttccaggacaggctttccatgaccagggacatgtccacaagtacagcctatatggaattgaggagcttgacatctgacgacacggccaactacttttgctcactgcaataattggtntcgtctacgtggggccagggaacggtggtcaccgtctcctcagcctccaccaagggcccatcggtccttcccctcggccaccctcctccaacgacg

SEQ ID NO: 70 - DNA, 347 bp, Homo sapiens
caggtgcagctggtgcagtctgatgctgacctgaggaaccccggggcctcagtgaaggtctcctgtaaggcctctggatatatattcaaaaatcaatatatacactgggtgcgacaggcccctggacaagggtttgagtggatgggacatctcaacccttggagcgggggcacagtttatgcacagaagttccaggacaggctttccatgaccagggacatgtccacaagtacagcctatatggaattgaggagcttgacatctgacgacacggccaacttacttttgctcactgcaatattggtgtcgtctacgtggggccagggaacgtggtcaccgtctcctca

SEQ ID NO: 71 - DNA, 395 bp, Homo sapiens
caggtgcagctggtgcagtctggggctgatgtgaagaagcctgggacatcagtaaaggtctcctgcaaggcttctggagacgccttcagcgactattatctacactgggtgcgacaggtcccaggacaaggccttgagtggatgggctggatggacccaaacaatggtgccacaaactatgcacccaagtttcagggcatgatcattatgaccagagacacgtccatcaatacagtttatttggagttgaggaggctgagatccgacgacacggccgtctatttttgtacgagagatgccagcgggccccagacgtattactatgacagtagtggttttgaatttgactcctggggccagggaacgctggtcattgtctcctcagcctccaccaa

SEQ ID NO: 72 - DNA, 367 bp, Homo sapiens
caggtgcagctggtgcaatctgggactgaaatgaagaagtctggggcctcactgaaagtctcctgtaagacctctggatacactttcagcgcccactacattcactgggtgcgccaggcccctggacagggccttgagtggatgggatggatcaaccctgacagtggtgccacaaaatttggccaggcttttcagggtagaatttctatgacaagagacacgtccaccgacacagtcaacctattattggtcaatttgagaccaaacgacacggccacatattactgcgcgagagattggcaatttcaagtcacttttggcgacttttatatggacatctggggcaacgggaccacggtcatcgtct

SEQ ID NO: 73 - DNA, 383 bp, Homo sapiens
caggtgcagctggtgcaatctgggactgaaatgaagaagtctggggcctcactgaaagtctcctgtaagacctctggatacactttcagcgcccactacattcactgggtgcgccaggcccctggacaaggccttgagtggatgggttggatcaaccctgacagtggtgacacaaattttgcccagacttttcagggtaggactaccttgacaagagacgcgttcgccaacacagtcaacctactattggccagtctgaaaccgaacgacacggccacatactactgcgcgagagattggcaatttcaaggcacttttggcgacttttacatggacatctggggcaacgggaccacggtcatcgtctccccagcctccaccaa

SEQ ID NO: 74 - DNA, 438 bp, Homo sapiens
caggtgcagctggtgtaatctgggactgaaatgaagaagtctggggcctcactgaaagtctcctgtaagacctctggatacactttcagcgcccactacattcactgggtgcgccaggcccctggacaaggccttgagtggatgggttggatcaaccctgacagtggtgacacaaattttgcccagacttttcagggtaggactaccttgacaagagacgcgttcgccaacacagtcaacctactattggccagtctgaaaccgaacgacacggccacatattactgcgcgagagattggcaatttcaaggcacttttggcgacttttacatggacatctggggcaacgggaccacggtcatcgtctcccagcctccaccaggcccatcggtcttcccctggccaccctcctccaagacgcacctcgtcggggcacga

SEQ ID NO: 75 - DNA, 391 bp, Homo sapiens
caggtgcagctggtgcaatctgggactgaaatgaagaagtctggggcctcactgaaagtctcctgtaagacctctggatacactttcagcgcccactacattcactgggtgcgccaggcccctggacaaggccttgagtggatgggttggatcaaccctgacagtggtgacacaaattttgcccagacttttcagggtaggactaccttgacaagagacgcgttcgccaacacagtcaacctactattggccagtctgaaaccgaacgacacggccacatattactgcgcgagagattggcaatttcaaggcacttttggcgacttttacatggacatctggggcaacgggaccacggtcatcgtctccccagcctccaccaacgggccca

SEQ ID NO: 76 - DNA, 367 bp, Homo sapiens
caggtgcagctggtgcaatctgggactgaaatgaagaagtctggggcctcactgaaagtctcctgtaagacctctggatacactttcagcgcccactacattcactgggtgcgccaggcccctggacaaggccttgagtggatgggttggatcaaccctgacagtggtgacacaaattttgcccagacttttcagggtaggactaccttgacaagagacgcgttcgccaacacagtcaacctactattggccagtctgaaaccgaacgacacggccacatattactgcgcgagagattggcaatttcaagtcacttttggcgacttttatatggacatctggggcaacgggaccacggtcatcgtct

SEQ ID NO: 77 - DNA, 459 bp, Homo sapiens
caggtgcagctggtgcagtctgggactgaaatgaagaagtctggggcctcactgaaagtctcctgtaagacttctggatacactttcagcgcccactatattcactgggtgcgccaggcccctggacaaggccttgagtggatgggttggatcaaccctgacagtggtgacacacattttgcccagacttttcaggttaggactaccttgacaagagatccgttcaccggcacagtcatcctcctattggccagtctgagaccgaacgacacggccacatattactgcgcgagagattggcaatttcaaggcacttttggcgacttttatatggacatctggggcaacgggaccacggtcatcgtctctccagcctccaccagggcccatcggtcttcccctggcaccctcctccaagacgcacctctggggcacagcggccctggctgcctggtcagg

SEQ ID NO: 78 - DNA, 458 bp, Homo sapiens
caggtgcagctggtgcagtctgggactgaaatgaagaagtctggggcctcagtgaaagtctcctgtgagacatctggatacactttcaccgcctattacattcactgggtgcgacaggcccccggacgaggccttgagtggatgggatggatcaaccctgacagtggggacacaaagtttgcccggacttttcagggtagaaccaccgtgacaagggacacatccaccaatacagtcaacttactactggccagtctacaatcgaacgacacggccacatattactgcgcgagagattggcagtttcaagtcacttttggcgactattatatggacatctggggcaacgggaccacggtcatcgtctccccagcctccaccaaggcccatcggtcttcccctggcaccctcctccaagacgcacctctggggcacagcggcctgggctgcctggtcaa

SEQ ID NO: 79 - DNA, 431 bp, Homo sapiens
caggtgcagctggtgcagtctgggactaaaatgatgaagtctggggcctcaatgaaagtcccttgtaagacatctggatacaccttcaccgcctactatattcactgggtacggcaggcccctggacgaggccttgagtggatgggatggatcaatcctgatagtggtgacacaaactttgcccagacttttaaggacagagtcaatatgacaagggacacgtcaaccaccacagtcaacctggtcttggtcaatttaagaagtgacgacacggccacctattactgcgcgagagattggcagtatcaggtcatttttggcgacttctatttggacatctggggcaacgggaccacggtcatcgtcgtctccagcctccaccaaggcccatcggtcttccccctggccaccctcctccaacgacgccacct

SEQ ID NO: 80 - DNA, 360 bp, Homo sapiens
caggtgcagctggtgcagtctggggcagaagtgaagaagactggggcctcagtgagggtctcctgcgagacctctggataccccttcaccaaccactatatacattgggtgcggcaggcccctggacatgggcttgagtggatggcctggatcaacccgagcggtggtgccacaatttatgcagaggcttttgagggcaggataatggtaagttcggacacgtccttgaatacagtctacatggagttggagagcctgacatctggcgacacggccatgtatttctgcgccagagatgcgactccgataactaccgaatttgacttctggggccagggaacactgatcaccgtctcctca

SEQ ID NO: 81 - DNA, 360 bp, Homo sapiens; identical to SEQ ID NO: 80

SEQ ID NO: 82 - DNA, 360 bp, Homo sapiens
  misc_feature (342)..(342): n is a, c, g, or t
caggtgcagctggtgcagtctggggctgaagtgaagaagcctggggcctcagtgaaggtttcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacnccggtcaccgtctcctca

SEQ ID NO: 83 - DNA, 420 bp, Homo sapiens
caggtgcagctggtgcagtctggggcagaagtgaagaagactggggcctcagtgagggtctcctgcgagacctctggataccccttcaccaaccactatatacattgggtgcggcaggcccctggacatgggcttgagtggatggcctggatcaacccgagcggtggtgccacaatttatgcagaggcttttgagggcaggataatggtaagttcggacacgtccttgaatacagtctacatggagttggagagcctgacatctggcgacacggccatgtatttctgcgccagagatgcgactccgataactaccgaatttgacttctggggccagggacactgatcaccgtctcctcagcctccaccaaggcccatcggtccttccccctcggccaccctcctccaacgacgccacctc

SEQ ID NO: 84 - DNA, 370 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctcacgcctccacc

SEQ ID NO: 85 - DNA, 427 bp, Homo sapiens
caggtgcagctggtgcagtctgggactgaggtgaagaagtctggggcctctgtgaaagtctcctgtcagacatctggatacactttcagcgcctactacattcactgggtgcgacaggcccctggacgaggccttgagtggctgggatggatcaaccctgacaatggtgacacaaaatttgcccagaattttcacggtagatccaccgtgacaagggacacatccaccagtacagtcaatttactcctgaccagtctacaaccgaacgacacggccacatattactgcgcgagagattggcagtttcaagtcatttttggcgactactacatggacatctggggcaacgggaccacggtcatcgtctccccagcctccaccaaggcccatcggtctccccctggccaccctcctccaacgacgcacc

SEQ ID NO: 86 - DNA, 371 bp, Homo sapiens
caggtgcagctggtgcagtctgggactgaggtgaagaagtctggggcctctgtgaaagtctcctgtcagacatctggatacactttcagcgcctactacattcactgggtgcgacaggcccctggacgaggccttgagtggctgggatggatcaaccctgacaatggtgacacaaaatttgcccagaattttcacggtagatccaccgtgacaagggacacatccaccagtacagtcaatttactcctgaccagtctacaaccgaacgacacggccacatattactgcgcgagagattggcagtttcaagtcatttttggcgactactacatggacatctggggcaacgggaccacggtcatcgtctcctc

SEQ ID NO: 87 - DNA, 363 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacg

SEQ ID NO: 88 - DNA, 381 bp, Homo sapiens
caggtgcagctggtgcagtctgggactgaaatgaagaagtctggggcctcaatgaaagtctcttgtaagacatctggatacactttcaccggctactacattcactgggtacgacaggcccctggacggggccttgagtggatgggatggatcaatcctaataatggtgacacaaattttgcccagagttttaaggacagagtcagtatgacaagggacacgtctaccaccacagtcaacctggtcttggccaatttaagaaatgacgacacggccacatattactgcgcgagagattggcagtatcaggtcatttttggcgacttctatttggacatctggggcaacgggaccacgatcatcgtctctccagcctccacc

SEQ ID NO: 89 - DNA, 349 bp, Homo sapiens
caggtgcagctggtgcagtcgggggctgaagtgaagaagcctggggcctcagtgaaggtctcctgtcaggcttctggatacggattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtc

SEQ ID NO: 90 - DNA, 370 bp, Homo sapiens
caggtgcagctggtgcagtctggggctgaagtgaagaagcctggggccccagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcctcacgcctccacc

SEQ ID NO: 91 - DNA, 358 bp, Homo sapiens
caggtgcagctggtgcagtcgggggctgaagtgaagaagcctggggcctcagtgaaggcctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcct

SEQ ID NO: 92 - DNA, 362 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtaggctcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcctcacg

SEQ ID NO: 93 - DNA, 360 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtaggctgggcaggttcaaccctgccaatggcggcacagatcttgcacagaagtttcagggtaggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcctca

SEQ ID NO: 94 - DNA, 366 bp, Homo sapiens
caggtgcagctggtgcagtcgggggctgaagtgaagaagcctggggcctcagtgaaggtctcctgtcaggcttctggatacagattcgccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcct

SEQ ID NO: 95 - DNA, 368 bp, Homo sapiens
caggtgcagctggtgcagtcgggggctgaagtgaagaagcctggggcctcagtgaaggtctcctgtcaggcttctggatacagattcaccgaccaacatttgaattggatacgacaagcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcctcc

SEQ ID NO: 96 - DNA, 371 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttagaactgagcaggctgacatctgacgacacggccacctattattgtctgaattctggttgacgaatgaatatcactatgaccacgtggggccagggaaccgccggtcaccgtctcctcacgcctccacc

SEQ ID NO: 97 - DNA, 379 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcctcacgcctccaccaacggccca

SEQ ID NO: 98 - DNA, 366 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcct

SEQ ID NO: 99 - DNA, 371 bp, Homo sapiens
caggtgcagctggtgcagtcgggggctgaagtgaagaagcctggggcctcagtgaaggtctcctgtcaggcttctggatacagattcaccgaccaacattttgaattggatacgacaggcccctggacaagggtttgagtggctgggcaggttcaaccctgccaatggcggcacagatcttgcacagaagtttcagggtaggtcagtatgaccagaaacatgtccatcaccacagcgtatttggaactgagcaggctgacatctgacgacacggccacctattattgtctgaattctggtcgacgaatgaatatcactatgaccacgtggggccagggaaccgccggtcaccgtctcctcacgcctccacc

SEQ ID NO: 100 - DNA, 366 bp, Homo sapiens
caggtgcagctggtgcagtcgggggctgaagtgaagaagcctggggcctcagtgaaggtctcctgtcaggcttctggatacagattcaccgaccaacattttgaattggatacgacaggcccctggacaagggtttgagtggctgggcaggttcaaccctgccaatggcggcacagatcttgcacagaagtttcagggtaggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcct

SEQ ID NO: 101 - DNA, 380 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctcacgcctccaccaacgggccca

SEQ ID NO: 102 - DNA, 375 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctcacgcctccaccaacgg

SEQ ID NO: 103 - DNA, 366 bp, Homo sapiens; identical to SEQ ID NO: 98

SEQ ID NO: 104 - DNA, 404 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcctccaccaacggcccacgtccggtccttcccccgtcggcc

SEQ ID NO: 105 - DNA, 370 bp, Homo sapiens
caggtgcagctggtgcagtcgggggctgaagtgaagaagcctggggcctcagtgaaggtctcctgtcaggcttctggatacagattcaccgaccaacattttgaattggatacgacaggcccctggacaagggtttgagtggctgggcaggttcaaccctgccaatggcggcacagatcttgcacagaagtttcagggtaggtcagtatgaccagaaacatgtccatcaccacagcgtatttggaactgagcaggctgacatctgacgacacggccacctattattgtctgaactctggttgacgaatgaatatcactatgaccacgtggggccagggaacgccggtcaccgtctcctcacgcctccacc

SEQ ID NO: 106 - DNA, 371 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcctccacc

SEQ ID NO: 107 - DNA, 370 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcggggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctcacgcctccacc

SEQ ID NO: 108 - DNA, 366 bp, Homo sapiens; identical to SEQ ID NO: 98

SEQ ID NO: 109 - DNA, 367 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcctcacgcctcc

SEQ ID NO: 110 - DNA, 341 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaac

SEQ ID NO: 111 - DNA, 360 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctca

SEQ ID NO: 112 - DNA, 363 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaaccgccggtcaccgtctcctcacg

SEQ ID NO: 113 - DNA, 348 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtc

SEQ ID NO: 114 - DNA, 361 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctca

SEQ ID NO: 115 - DNA, 373 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctcacgcctccaccaac

SEQ ID NO: 116 - DNA, 406 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaaccgccggtcaccgtctcctcacgcctccaccaacggcccatccggtccttcccccgtcggccaccc

SEQ ID NO: 117 - DNA, 368 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcctcc

SEQ ID NO: 118 - DNA, 372 bp, Homo sapiens
caggtgcagctggtcagtcgggggctgaagtgaagaagcctggggcctcagtgaaggtctcctgtcaggcttctggatacagattcaccgaccaacatttgaattggatacgacaggccccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctcacgcctccaccaa

SEQ ID NO: 119 - DNA, 365 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaactctggttgacgaatgaatatcactatgaccacgtggggccagggaaccgccggtcaccgtctcctcacgcc

SEQ ID NO: 120 - DNA, 358 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcct

SEQ ID NO: 121 - DNA, 363 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccggaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacg

SEQ ID NO: 122 - DNA, 408 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcctcacgcctccaccaacgggcccacgtccggtccttcccccgtcggccaccc

SEQ ID NO: 123 - DNA, 349 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtc

SEQ ID NO: 124 - DNA, 371 bp, Homo sapiens; identical to SEQ ID NO: 106

SEQ ID NO: 125 - DNA, 361 bp, Homo sapiens
caggtgcagctggtgcagtcgggggctgaagtgaagaagcctggggcctcagtgaaggtctcctgtcaggcttctggatacagattcaccgaccaacatttggattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctca

SEQ ID NO: 126 - DNA, 361 bp, Homo sapiens; identical to SEQ ID NO: 114

SEQ ID NO: 127 - DNA, 359 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaaagtttcagggtagggtcagtatgaccagaaacatgtccatcaccacagcgtatttggaactgagcaggctgacatctgacgacacggccacctattattgtctgaattctggttgacgaatgaatatcactatgaccactggggccagggaacgccggtcaccgtctcctc

SEQ ID NO: 128 - DNA, 370 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctcacgcctccacc

SEQ ID NO: 129 - DNA, 405 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttggacgaatgaatatcactatgaccactggggccagggaacgccggtcaccgtctcctcacgcctccaccaacggcccatccggtccttcccccgtcggccaccc

SEQ ID NO: 130 - DNA, 361 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaacccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccactggggccagggaaccgccggtcaccgtctcctca

SEQ ID NO: 131 - DNA, 365 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcc

SEQ ID NO: 132 - DNA, 371 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtctcctcacgcctccacc

SEQ ID NO: 133 - DNA, 360 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcctca

SEQ ID NO: 134 - DNA, 368 bp, Homo sapiens; identical to SEQ ID NO: 117

SEQ ID NO: 135 - DNA, 357 bp, Homo sapiens
caggtgcagctggtgcagtcgggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaaccgccggtcaccgtcct

SEQ ID NO: 136 - DNA, 423 bp, Homo sapiens
caggtgcagctggtgcagtctggggctgaagtgaagaagcctggggcctcagtgaaggtctcctgtcaggcttctggatacagattcaccgaccaacatttgaattggatacgacaggcccctggacaagggtttgagtggctgggcaggttcaaccctgccaatggcggcacagatcttgcacagaagtttcagggtagggtcagtatgaccagaaacatgtccatcaccacagcgtatttggaactgagcaggctgacatctgacgacacggccacctattattgtctgaattctggttgacgaatgaatatcactatgaccacgtggggccagggaacgccggtcaccgtctcctcacgcctccaccaacgggcccactccggtccttccccctcggccacccgtcctccaacgacgcca

SEQ ID NO: 137 - DNA, 446 bp, Homo sapiens
caggtgcagctggtgcagtcgggggctgaggtgaagaagcctggggcctcagtgaaagtctcctgtaaggctactggatatagattcaccgactaccatttgatctggatacgacaggcccctggacaagggtttgagtgggtgggcaggttcaaccctgccaatggcgtcacaaatcttgcgcagaagtttcaggatagggtcagtatgaccaggaacacgtccatcactacagcctatttggaactgagcaggctgacacctgacgacacggccacctattattgtgtgaattccggttgggatattgactatcactatgaccactggggccagggaacgctggtcatcgtctcctcagcctccaccaaggcccatcggtcttccccctggcaccctcctccaagagcacctctggggcacagcagccctggctgcctggtcaa

SEQ ID NO: 138 - DNA, 379 bp, Homo sapiens
caggtgcagctggtgcagtcgggggctgaggtgaagaagcctggggcctcagtgaaagtctcctgtaaggctactggatatagattcaccgactaccatttgatctggatacgacaggcccctggacaagggtttgagtgggtgggcaggttcaaccctgccaatggcgtcacaaatcttgcgcagaagtttcaggatagggtcagtatgaccaggaacacgtccatcactacagcctatttggaactgagcaggctgacacctgacgacacggccacctattattgtgtgaattccggttgggatattgactatcactatgaccactggggccagggaacgctggtcatcgtctcctcagcctccaccaacgggccca

SEQ ID NO: 139 - DNA, 450 bp, Homo sapiens
caggtgcagctggtgcagtctggggcagaggtgaagaagcctggggcctcagtgaaagcctcctgcgggacttctggatacaccttcgccaactactacatacattggctgcggcaggcccctggacaaggacttgagtggatggcctggatcaacccaggcagtggttccacgatctattcagagaattttgagggcagggtcaccgtaaccagtgacacatccatgcaaacggtctacatggacttggacagtctgacatctcgcgacacggccgtctattattgtgccagagatgcaactccaccaactacggaatttgaccactggggccaaggaacgctgatcaccgtgtcctcagcctccaccaagggcccatcggtcttccccctggcaccctcctccaagagcacctctggggcacagcggccctgggctgcctggtcaagg

SEQ ID NO: 140 - DNA, 424 bp, Homo sapiens
caggtgcagctggtgcagtctggggctgaggtgaagatgcttggggcctcagtgaaagtctcctgccaggcttctggccacaagttcaccaactactatatacattgggtgcgacaggcccctggacaagggcttgagtggatgggatggatcaaccctcagaatggtgacaataattttggaatgagatttcaggatagggtcaccacgaccagtgacaggtccaccaggacagtgtatttggagttgagtggcctgacacctgacgacacggccatgtatttttgcacgagatttctgaaacctgtggaatattacgatagaagtggtccccaatttgggtattggggccagggaaccctggtctccgtctcctcagcctccaccaggcccatcggtcttccccctggccaccctcctccaa

SEQ ID NO: 141 - DNA, 371 bp, Homo sapiens
caggtgcagctggtgcagtcgggggctgaggtgaagaagcctggggcctcagtgaaagtctcctgtaaggctactggatatagattcaccgactaccatttgatctggatacgacaggcccctggacaagggtttgagtgggtgggcaggttcaaccctgccaatggcgtcacaaatcttgcgcagaagtttcaggatagggtcagtatgaccaggaacacgtccatcactacagcctatttggaactgagcaggctgacacctgacgacacggccacctattattgtgtgaattccggttgggatattgactatcactatgaccactggggccagggaacgctggtcatcgtctcctcagcctccaccaa

SEQ ID NO: 142 - DNA, 403 bp, Homo sapiens
caggtgcagctggtgcagtctggggcagaggtgaagaagcctggggcctcagtgaaagtctcctgcgggacttctggatacaccttcgccaactactacatacattggctgcggcaggcccctggacaaggacttgagtggatggcctggatcaacccaggcagtggttccacgatctattcagagaattttgagggcagggtcaccgtaaccagtgacacatccatgcaaacggtctacatggacttggacagtctgacatctcgcgacacggccgtctattattgtgccagagatgcaactccaccaactacggaatttgaccactggggccaaggaacgctgatcaccgtgtcctcagcctccaccaacggcccatccggtccttccccctcggccaccc

SEQ ID NO: 143 - DNA, 369 bp, Homo sapiens
caggtgcagctggtgcagtctggggcagaggtgaagaagcctggggcctcagtgaaagtctcctgcgggacttctggatacaccttcgccaactactacatacattggctgcggcaggcccctggacaaggacttgagtggatggcctggatcaacccaggcagtggttccacgatctattcagagaattttgagggcagggtcaccgtaaccagtgacacatccatgcaaacggtctacatggacttggacagtctgacatctcgcgacacggccgtctattattgtgccagagatgcaactccaccaactacggaatttgaccactggggccaaggaacgctgatcaccgtgtcctcagcctccacc

SEQ ID NO: 144 - DNA, 361 bp, Homo sapiens
caggtgcagctggtgcagtctggggcagaggtgaagaagcctggggcctcagtgaaagtctcctgcgggacttctggatacaccttcgccaactactacatacattggctgcggcaggcccctggacaaggacttgagtggatggcctggatcaacccaggcagtggttccacgatctattcagagaattttgagggcagggtcaccgtaaccagtgacacatccatgcaaacggtctacatggacttggacagtctgacatctcgcgacacggccgtctattattgtgccagagatgcaactccaccaactacggaatttgaccactggggccaaggaacgctgatcaaccgtgtcctca

SEQ ID NO: 145 - DNA, 389 bp, Homo sapiens
caggtgcagctggtgcagtctggggcagaggtgaagaagcctggggcctcagtgaaagtctcctgccaggcttctggccacaagttcaccaactactatatacattgggtgcgacaggcccctggacaagggcttgagtggatgggatggatcaaccctcagaatggtgacaataattttggaatgagatttcaggatagggtcaccacgaccagtgacaggtccaccaggacagtgtatttggagttgagtggcctgacacctgacgacacggccatgtatttttgcacgagatttctgaaacctgtggaatattacgatagaagtggtccccaatttgggtattggggccagggaaccctggtctccgtctcctcagcctccaccaa

SEQ ID NO: 146 - DNA, 360 bp, Homo sapiens
caggtgcagctggtgcagtctggggcagaggtgaagaagcctggggcctcagtgaaagtctcctgcgggacttctggatacaccttcgccaactactacatacattggctgcggcaggcccctggacaaggacttgagtggatggcctggatcaacccaggcagtggttccacgatctattcagagaattttgagggcagggtcaccgtaaccagtgacacatccatgcaaacggtctacatggacttggacagtctgacatctcgcgacacggccgtctattattgtgccagagatgcaactccaccaactacggaatttgaccactggggccaaggaacgctgatcaccgtgtcctca

SEQ ID NO: 147 - DNA, 377 bp, Homo sapiens
caggtgcagctggtgcagtctggggctcaggtgctgaagcctggggcctcagtgaagctctcctgcaagacttctgggtacaccttcagcgacttctatacccactgggtgcgacaggtccctggccgacgtcttgagtggatgggttggttcaatcctaatagtggtggcgcccactatggactggactttcagggcagagtcacatcggcgggggacacgtcaatcaccacggtctacatggaactgaccaggctggcttttgacgacacggccatctattactgtgcgagagaggcacattgtgggactaccagctgccaatttgactcctggggccagggaacgctggtcaccgtctcctcggcctccaccaa

SEQ ID NO: 148 - DNA, 346 bp, Homo sapiens
caggtgcagctggtgcagtttggggctgacgtggagaagcctggggcctcagtgagagtctcgtgtaaggcctctggatatgacttcattaactattatatacattaggtgcggcaggcccctggacaagggcttgagtggatggcctggatcaaccctagcggtggtgccacaatctatgcggagagttttgagggcagggtcaccgtaaccagggacacgtccatgagcaccgtctacatggaattggagagcctgacatctggcgacacggccatgtattactgcgccagagatgcgactccgataactacggaatttgtctactggggccagggaacactga

SEQ ID NO: 149 - DNA, 366 bp, Homo sapiens
caggtgcagctggtgcagtctggggctgaggtgaagaagccggggtcctcagtgaaggtctcctgcaaggcttctgggggcaccttcagtagctctgctgttaactgggtgcgacaggcccctggaaaacgtcttgagtgggtggggtggttcaatcctaagactggtggcgcgcactatggactggactatcagggcagagtgacgatgaccggggacacgtccatcaccacagtctacatggagttgaccagattggcatccgacgacacggccatgtattattgtgcgagagagggagtttgtagaactaccagctgccaatttgacttctggggccagggaacgctggtcaccgtcttctca

SEQ ID NO: 150 - DNA, 352 bp, Homo sapiens
caggtgcagctggtgcagtttggggctgacgtggagaagcctggggcctcagtgagagtctcgtgtaaggcctctggatatgacttcattaactattatatacattgggtgcgacaggcccctggacaaggacttgagtggatgggatgtatcaatcctaggactggtgacacaaagtatgcacagaggtttcaggacgaggtctccatgaccagggacacgtccatcagtacagtctacatggagctgagagaaatgacctatgacgacacggccatctatttttgtctcactgcaatagacggtgtctcgtactggggcctgggaaagctggtcaccgtcgcctcagcct

SEQ ID NO: 151 - DNA, 347 bp, Homo sapiens
caggtgcagctggtgcagtttggggctgacgtggagaagcctggggcctcagtgagagtctcgtgtaaggcctctggatatgacttcattaactattatatacattgggtgcgacaggcccctggacaaggacttgagtggatgggatgtatcaatcctaggactggtgacacaaagtatgcacagaggtttcaggacaaggtctccatgaccagggacacgtccatcagtacagtctacatggagctgagagaaatgacctatgacgacacggccatctattttgtctcactgcaatagacggtgtctcccgtatggggcctgggaaagctggtcaccgtcgcctc

SEQ ID NO: 152 - DNA, 360 bp, Homo sapiens
caggtgcagctggtgcagtctggggctgaggtgaagaagcctggggcctcagtgaaagtctcctgcgggacttctggatacaccttcgccaactactacatacattggctgcggcaggcccctggacaaggacttgagtggatggcctggatcaacccaggcagtggttccacgatctattcagagaattttgagggcagggtcaccgtaaccagtgacacatccatgcaaacggtctacatggacttggacagtctgacatctcgcgacacggccgtctattattgtgccagagatgcaactccaccaactacggaatttgaccactggggccaaggaacgctgatcaccgtgtcctca

SEQ ID NO: 153 - DNA, 368 bp, Homo sapiens
caggtgcagctggtgcaatctggggctgaaatgatgaagcctggggcctcactgaaggtctcctgtcagacttcaggatataacttcaatggccattttctacactgggtgcgacaggcccctggacaagggcttgagtggatggcaaggatcaaccctagtagtggtgtcacagattttgcccagaagtttcaggacagagtcaccgtgaccagggacagtctccgacaactacaatctacaataggaattacataggctgcgatctgatgacacggccgtgtattactgtgcgagagatgggatcatttcgacttggtctttttgacgtggggccagggaacgcgtggtcaccgtctcctctcgcc

SEQ ID NO: 154 - DNA, 359 bp, Homo sapiens
caggtgcagctggtgcagtttggggctgacgtggagaagcctggggcctcagtgagagtctcgtgtaaggcctctggatatgacttcattaactattatatacattgggtgcgacaggcccctggacaaggacttgagtggatgggatgtatcaatcctaggactggtgacacaaagtatgcacagaggtttcaggacaaggtctccatgaccagggacacgtccatcagtacagtctacatggagctgagagaaatgacctatgacgacacggccatctatttttgtctcactgcaatagacggtgtctcgtactggggcctgggaaagctggtcaccgtcgcctcagcctccaccaa

SEQ ID NO: 155 - DNA, 360 bp, Homo sapiens
caggtgcagctggtgcagtctgatgctgacctgaggaaccccggggcctcagtgaaggtctcctgtaaggcctctggatatatattcaaaaatcaatatatacactgggtgcgacaggcccctggacaagggtttgagtggatgggacatctcaacccttggagcgggggcacagtttatgcacagaagttccaggacaggctttccatgaccagggacatgtccacaagtacagcctatatggagctgagcagactgagatttgacgacacggccgtatattactgtgcgagagacccccaagaggtcagtggctggtacacgcactggggccagggaacgctggtcaccgtctcctca

SEQ ID NO: 156 - DNA, 357 bp, Homo sapiens
caggtgcagctggtgcaatctggggctgaaatgatgaagcctggggcctcactgaaggtctcctgtcagacttcaggatataacttcaatggccattttctacactgggtgcgacaggcccctggacaagggcttgagtggatggcaaggatcaaccctagtagtggtgtcacagattttgcccagaagtttcaggacagagtcaccgtgaccagggacatctccacaactacaatctacatggaattacataggctgcgatctgatgacacggccgtgtattactgtgcgagagatgggatcatttcgactggtctttttgactggggccagggaaccctggtcaccgtctcctca

SEQ ID NO: 157 - DNA, 414 bp, Homo sapiens
caggtgcagctggtgcaatctggggctggggtgaggaagcctgggtcctcggtgatggtctcctgcaaggcttctggagacaccttcaacaactactatatacattgggtgcggcaggcccctggacatgggacttagaagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaacggcccactcggtccttccccctcggccaccctcctccaa

SEQ ID NO: 158 - DNA, 352 bp, Homo sapiens
caggtgcagctggtgcagtttggggctgacgtggagaagcctggggcctcagtgagagtctcgtgtaaggcctctggatatgacttcattaactattatatacattgggtgcgacaggcccctggacaaggacttgagtggatgggatgtatcaatcctaggactggtgacacaaagtatgcacagaggtttcaggacaaggtctccatgaccagggacacgtccatcagtacagtctacatggagctgagagaaatgacctatgacgacacggccatctatttttgtctcactgcaatagacggtgtctcgtactggggcctgggaaagctggtcaccgtcgcctcagcct

SEQ ID NO: 159 - DNA, 521 bp, Homo sapiens
caggtgcagctggtgcagtctggggctgaggtgaagaagcctggggcctcaatgaaggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatccgacgagacggccgtttattattgtgcgagagactttagcgacggttggccttactccttcgacttctggggccagggaactctagtcaccgtctcctcagcctccaccaagggcccatcggtcttcccctggcaccctcctccaagagcacctctgggggcacagcggccctgggctgcctggtcaaggactacttcccgaaccggtgacggtgtcgtggaactcaggcgccctgaccagcggcgtgcacaccttcc

SEQ ID NO: 160 - DNA, 366 bp, Homo sapiens
caggtgcagctggtgcagtctggggctgaaatgatgaagcctggggcctcactgaaggtctcctgtcagacttcaggatataacttcaatggccattttctacactgggtgcgacaggcccctggacaagggcttgagtggatggcaaggatcaaccctagtagtggtgtcacagattttgcccagaagtttcaggacagagtcaccgtgaccagggacatctccacaactacaatctacatggaattacataggctgcgatctgatgacacggccgtgtattactgtgcgagagatgggatcatttcgactggtctttttgactggggccagggaacgctggtcaccgtctcctctgcctccacc

SEQ ID NO: 161 - DNA, 395 bp, Homo sapiens
caggtgcagctggtgcaatctgggtctcaaatgaagaagtctggggcctcactgaatgtctcctgtcagacttctggatacacattcagcgactactatcttcactgggtgcgacgggcccctggacaaggccttcagtggatgggatggatcaatcctgagaatggtgacacaaattatgcccagacatttaagggcagggtcaccatgaccagggacacagccattaatacagcctacatggtgttgaccggtctaaaatttaacgacacggccatgtattattgtgcgagagattggcagttccatgtcatttttgacgactattacatagacgtctggggcacaggaaccacggtcatcgtctcctcagcctccaccaagggcccatcggt

SEQ ID NO: 162 - DNA, 366 bp, Homo sapiens
caggtgcagctggtgcagtctggggctcaggtgctgaagcctggggcctcagtgaagctctcctgcaagacttctgggtacaccttcagcgacttctatatccactgggtgcgacaggtccctggccgacgtcttgagtggatgggttggttcaatcctaatagtggtggcgcccactatggactggactttcagggcagagtcacatcggcgggggacacgtcaatcaccacggtctacatggaactgaccaggctggcttttgacgacacggccatctattactgtgcgagagaggcacattgtgggactaccagctgccaatttgactcctggggccagggaacgctggtcaccgtctcctca

SEQ ID NO: 163 - DNA, 369 bp, Homo sapiens
caggtgcagctggtgcagtctggggctcaggtgctgaagcctggggcctcagtgaagctctcctgcaagacttctgggtacaccttcagcgacttctatatccactgggtgcgacaggtccctggccgacgtcttgagtggatgggttggttcaatcctaatagtggtggcgcccactatggactggactttcagggcagagtcacatcggcgggggacacgtcaatcaccacggtctacatggaactgaccaggctggcttttgacgacacggccatctattactgtgcgagagaggcacattgtgggactaccagctgccaatttgactcctggggccagggaacgcgtggtcaccgtctcctcacg

SEQ ID NO: 164 - DNA, 388 bp, Homo sapiens
caggtgcagctggtgcaatctggggctgaagtgaggaagcctggggcctcagtgaaggtctcctgcgtggcgtctggatacaccctcagcgaccactttttacactgggtgcgtcgggcccctggacatggccttgagtggcttggatggactaaccctcagaatggtttcacaaattttgcacaagactttcaggacagggtcaccatgaccagtgacacgtccaccggcacagcctatatggagttaaataggctgacatctgccgacacggccatatattactgtgcgagaggagcccaccgtcactctgataggagtggttattactctgaaattgacgcctggggccagggaaccctggtcaccgtctcctcacgcctccacc

SEQ ID NO: 165 - DNA, 415 bp, Homo sapiens
caggtgcagctggtgcagcctggggctgaggtgaagaagcctgcgtcctcagtgaaggtctcctgccaggcttccagatacaccttcaccaaatactttacacagtgggtgcgacagggccctggacaagggcatgagtggttgggatgcatcaacccttacaatgataacacacactacgcacagaagttctggggcagagtcaccattaccagtgacaggtctgtgagcacagcctacatggagctgagcagcctgagatctgaagacatggtcgtgtattcctgtgtgccctgggggaatccaaccggagattactactactactactacatggacgtctggggcaaagggaccacggtcaccgtctcctcaggatgcatccgcccaaccctttcccctcgtctcctctgac

SEQ ID NO: 166 - DNA, 408 bp, Homo sapiens
caggtgcagctggtgcagtctggggctaaaatagggaaacctggggcctcagtgcaagtctcctgcaaggcctctgaatataccttcaccgacttctatatacactgggtgcgacagacccctggacaagggcttgagtggatgggatggatcaacgctaacactggcgccacagagtttgcacagaagtttctgggcagaatcatcatgaccagggacacttccatcaacacggtctacatggaactgagtagactgatatttaacgacacggccatttattattgtgcgagtgcctatgcgagtagtggtgagtttctttattggggccagggatcccgcgtcaccgtctcctcagggagtgcatccgccccaacccttttcccctcgtctcctctgagaattccc

SEQ ID NO: 167 - DNA, 354 bp, Homo sapiens
caggtgcagctggtgcagtctggggcagaggtgaagaagcctggggcctcagtgaaggtctcctgcgggacttctggatacaccttcgccaattactatatacattggctgcggcaggcccctggacaaggacttgagtggatggcctggatcaaccctagcggtggctccacaatctattcagagaattttgagggcagggtcaccgtaaccagggacacgtccatgaaaacggtctacatggaattggacagtctcacatctggcgacacggccgtgtattattgtgccagagatgcgactccggtaactacggaatttgactactggggccagggaacgctgatcaccgtc

SEQ ID NO: 168 - DNA, 408 bp, Homo sapiens
caggtgcagctggtgcagtctggggctgaaatagggaaacctggggcctcagtgcaagtctcctgcaaggcctctgaatataccttcaccgacttctatatacactgggtgcgacagacccctggacaagggcttgagtggatgggatggatcaacgctaacactggcgccacagagtttgcacagaagtttctgggcagaatcatcatgaccagggacacttccatcaacacggtctacatggaactgagtagactgatatttaacgacacggccatttattattgtgcgagtgcctatgcgagtagtggtgagtttctttattggggccagggatcccgcgtcaccgtctcctcagggagtgcatccgccccaacccttttcccctcgtctcctctgagaattccc

SEQ ID NO: 169 - DNA, 369 bp, Homo sapiens
caggtgcagctggtgcagtctggggcagaggtgaagaagcctggggcctcagtgaaggtctcctgcgggacttctggatacaccttcgccaattactatatacattggctgcggcaggcccctggacaaggacttgagtggatggcctggatcaaccctagcggtggctccacaatctattcagagaattttgagggcagggtcaccgtaaccagggacacgtccatgaaaacggtctacatggaattggacagtctcacatctggcgacacggccgtgtattattgtgccagagatgcgactccggtaactacggaatttgactactggggccagggaacgctgatcaccgtctcctcagcctccacc

SEQ ID NO: 170 - DNA, 367 bp, Homo sapiens
caggtgcagctggtgcagtctggggcagaggtgaagaagcctggggcctcagtgaaggtctcctgcgggacttctggatacaccttcgccaattactatatacattggctgcggcaggcccctggacaaggacttgagtggatggcctggatcaaccctagcggtggctccacaatctattcagagaattttgagggcagggtcaccgtaaccagggacacgtccatgaaaacggtctacatggaattggacagtctcacatctggcgacacggccgtgtattattgtgccagagatgcgactccggtaactacggaatttgactactggggccagggaacgctgatcaccgtctcctcacgcctcc

SEQ ID NO: 171 - DNA, 362 bp, Homo sapiens
caggtgcagctggtgcagtctggggcagaggtgaagaagcctggggcctcagtgaaggtctcctgcgggacttctggatacaccttcgccaattactatatacattggctgcggcaggcccctggacaaggacttgagtggatggcctggatcaaccctagcggtggctccacaatctattcagagaattttgagggcagggtcaccgtaaccagggacacgtccatgaaaacggtctacatggaattggacagtctcacatctggcgacacggccgtgtattattgtgccagagatgcgactccggtaactacggaatttgactactggggccagggaacgctgatcaccgtctcctcacg

SEQ ID NO: 172 - DNA, 360 bp, Homo sapiens
caggtgcagctggtgcagtctggggcagaggtgaagaagcctggggcctcagtgaaggtctcctgcgggacttctggatacaccttcgccaactactatatacattgggtgcgtcaggcccctggacatgggcttgagtggatggcctggatcaaccctagcggtggttccacaatctatgcagagagttttgagggcagggtcaccgtaaccgcggacacgtccatgaagacagtctacatggaattggagagcctgacatctggcgacacggccatgtatttctgcgccagagatgcgactccgatgactacggaatttgactactggggccagggaacactgatcaccgtctcctca

SEQ ID NO: 173 - DNA, 399 bp, Homo sapiens
caggtgcagctggtgcagtctggggctgaagtaaagaaacctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgccccaaagtttcagggcagggtcacgattaccgctgacatacccacgaacacagcctacttggagttgagcagcctgagatctgacgatgcggccgtctactactgtgcgaggggatccatcctagacatgtctacagcgtcttcctattattacgttatggacgtctggggccaagggaccacagtcaccgtctcctcagcttccaccaagggccca

SEQ ID NO: 174 - DNA, 360 bp, Homo sapiens
caggtgcagctggtgcagtctggggcagaggtgaagaagcctggggcctcagtgaaggtctcctgcgggacttctggatacaccttcgccaattactatatacattggctgcggcaggcccctggacaaggacttgagtggatggcctggatcaaccctagcggtggctccacaatctattcagagaattttgagggcagggtcaccgtaaccagggacacgtccatgaaaacggtctacatggaattggacagtctcacatctggcgacacggccgtgtattattgtgccagagatgcgactccggtaactacggaatttgactactggggccagggaacgctgatcaccgtctcctca

SEQ ID NO: 175 - DNA, 373 bp, Homo sapiens
caggtgcagctggtgcagtctggggctgaggtgaagaagcctgggacatcagtaaaagtctcctgcaaggcctttggatacgccttcagcgactattatctacactgggtgcgacaggtcccaggacaaggccttgagtggatgggctggatggacccaaacaatggtgccacaaactatgcacccaagtttcagggcatgatcattatgaccagagacacgtcccatcaatacagtttatttggagttgaggaggctgagatccgacgacacggccgtctatttttgtacgggagatgccggcgggccccagacgtattactatgacagtagtggtttgaatttgactcctggggccagggaacgctggtca

SEQ ID NO: 176 - DNA, 372 bp, Homo sapiens
caggtgcagctggtgcaatctgggtctgaagtgaagaagtctggggcctcagtgagcgtctcctgcaaggcctctggatacagcttcaccgactactatcttcactgggtgcgacaggcccctggacagggccttcagtggatgggatggatcaatcctgagagtggtgacacaaactatgcgcgggcctttcggggcaggatcaccatgaccagggacacgtccattaatactgcctatatgatgttgaccggcctaaggtctaacgacacggccgtctatttctgtgcgagagactggcagttccacgtcatctttgacgactactacatagacgcctggggcaaagggaccacagtcatcgtctcctca

SEQ ID NO: 177 - DNA, 366 bp, Homo sapiens
caggtgcagctggtgcagtctgggactgacgcgcggaagcctggggcctcagtgaaggtctcctgcaaggcttctggatacagcttcaccgactattatatacactgggtgcgacaggcccctggaaaacgtcttgagtgggtggggtggttcaatcctaagactggtggcgcgcactatggactggactatcagggcagagtgacgatgaccggggacacgtccatcaccacagtctacatggagttgaccagattggcatccgacgacacggccatgtattattgtgcgagagagggagtttgtagaactaccagctgccaatttgacttctggggccaagggacactggtcaccgtctcttca

SEQ ID NO: 178 - DNA, 365 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctatctggagctcagtgccctgagatctgacgagacggccgtttattattgtgcgagagactttagcgacggttggccttactccttcgacttctggggccagggaactctagtccaccgtctcctcag

SEQ ID NO: 179 - DNA, 421 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggagccacaatctatgcagaggcttttgagggcagagtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagggagtgcatccgccccaacccttttccccctcgtcctcctctgacgaacttcccatacgt

SEQ ID NO: 180 - DNA, 424 bp, Homo sapiens
caggtgcagctggtgccgtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcaggacagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcacgcctccaccaacgggcccatcggtccttccccctggccaccctcctccaacgacgccacc

SEQ ID NO: 181 - DNA, 367 bp, Homo sapiens
caggtgcagctggtgcagtctgggactgacgcgcggaagcctggggcctcagtgaaggtctcctgcaaggcttctggatacagcttcaccgactattatatacactgggtgcgacaggcccctggaaaacgtcttgagtgggtggggtggttcaatcctaagactggtggcgcgcactatggactggactatcagggcagagtgacgatgaccggggacacgtccatcaccacagtctacatggagttgaccagattggcatccgacgacacggccatgtattattgtgcgagagagggagtttgtagaactaccagctgccaatttgacttctggggccagggaacgctggtcaccgtcttctcag

SEQ ID NO: 182 - DNA, 354 bp, Homo sapiens
caggtgcagctggtgcagtctgggactgacgcgcggaagcctggggcctcagtgaaggtctcctgcaaggcttctggatacagcttcaccgactattatatacactgggtgcgacaggcccctggaaaacgtcttgagtgggtggggtggttcaatcctaagactggtggcgcgcactatggactggactatcagggcagagtgacgatgaccggggacacgtccatcaccacagtctacatggagttgaccagattggcatccgacgacacggccatgtattattgtgcgagagagggagtttgagaactaccagctgccaatttgacttcgtggggccagggaacgcgtggt

SEQ ID NO: 183 - DNA, 407 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggagccacaatctatgcagaggcttttgagggcagagtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaaggcccatcggtcttccccctggccaccctcctccaa

SEQ ID NO: 184 - DNA, 365 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcct

SEQ ID NO: 185 - DNA, 374 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccacatatttctgcgccagagatgcgactccgataactacggaatttgactactggggccagggaacactgatcaccgtctcctcagcctccaccaacgg

SEQ ID NO: 186 - DNA, 421 bp, Homo sapiens
caggtgcagctggtgcagtctgggactgacgcgcggaagcctggggcctcagtgaaggtctcctgcaaggcttctggatacagcttcaccgactattatatacactgggtgcgacaggcccctggaaaacgtcttgagtgggtgggatggttcaatcctaagactggtggcgcgcactatggactggactatcagggcagagtgacgatgaccggggacacgtccatcaccacagtctacatggagttgaccagattggcatccgacgacacggccatgtattattgtgcgagagagggagtttgtagaactaccagctgccaatttgacttctggggccagggaacgctggtcaccgtcttctcagcctccaccaacgggcccatccggtcttccccctggccaccctcctccaacgacg

SEQ ID NO: 187 - DNA, 367 bp, Homo sapiens
caggtgcagctggtgcagtctggggctgaggtgaagaagcctgggacatcagtaaaagtctcctgcaaggcctttggatacgccttcagcgactattatctacactgggtgcgacaggtcccaggacaaggccttgagtggatgggctggatggacccaaacaatggtgccacaaactatgcacccaagtttcagggcatgatcattatgaccagagacacgtccatcaatacagtttatatggagttgaggaggctgagatccgacgacacggccgtctatttttgtacgagagatgccggcgggccccagacgtattactatgacagtagtggtttgaatttgactccgtggggccagggaacgc

SEQ ID NO: 188 - DNA, 402 bp, Homo sapiens
caggtgcagctggtgcagtctggggcagaggtgaggaagcctggggcctcagtgaaggtctcctgcgggacttctggatacaccttcgccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacgggcccactccggtccttccccctcggcc

SEQ ID NO: 189 - DNA, 366 bp, Homo sapiens
caggtgcagctggtgcagtctgggactgacgcgcggaagcctggggcctcagtgaaggtctcctgcaaggcttctggatacagcttcaccgactattatatacactgggtgcgacaggcccctggaaaacgtcttgagtggtggggtggttcaatcctaagactggtggcgcgcactatggactggactatcagggcagagtgacgatgaccgggggacacgtccatcaccacagtctacatggagttgaccagattggcatccgacgacacggccatgtattattgtgcgagagagggagtttgtagaactaccagctgccaatttgacttctggggccagggaacgctggtcaccgtcttctca

SEQ ID NO: 190 - DNA, 384 bp, Homo sapiens
caggtgcagctggtgcagtctggggctgaggtgaagaagcctgggacatcagtaaaagtctcctgcaaggcctttggatacgccttcagcgactattatctacactgggtgcgacaggtcccaggacaaggccttgagtggatgggctggatggacccaaacaatggtgccacaaactatgcacccaagtttcagggcatgatcattatgaccagagacacgtccatcaatacagtttatttggagttgaggaggctgagatccgacgacacggccgtctatttttgtacgagagatgccggcgggccccagacgtattactatgacagtagtggttttgaatttgactcctggggccagggaacgctggtcattgtctcctca

SEQ ID NO: 191 - DNA, 370 bp, Homo sapiens
caggtgcagctggtgcagtctggggcagaggtgaagaagcctggggcctcagtgaaggtctcctgcgggacttctggatacaccttcgccaattactatatacattggctgcggcaggcccctggacaaggacttgagtggatggcctggatcaaccctagcggtggctccacaatctattcagagaattttgagggcagggtcaccgtaaccagggacacgtccatgaaaacggcctacatggaattggacagtctcacatctggcgacacggccgtgtattattgtgccagagatgcgactccggtaactacggaatttgactactggggccagggaacgctgatcaccgtctcctcacgcctccacc

SEQ ID NO: 192 - DNA, 411 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggagccacaatctatgcagaggcttttgagggcagagtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagggagtgcatccgccccaacccttttcccctcgtctcctctgagaattccc

SEQ ID NO: 193 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggagccacaatctatgcagaggcttttgagggcagagtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 194 - DNA, 379 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcgccgtaaccacggacacgtccatgaaaacagtctacatggagttggagagcctgacgtctggcgacacggccatgtatttctgcgccagagatgcgactccgataactacggaatttgactactggggccagggaacactgatcaccgtctcctcacgcctccaccaacggccca

SEQ ID NO: 195 - DNA, 360 bp, Homo sapiens; identical to SEQ ID NO: 193

SEQ ID NO: 196 - DNA, 384 bp, Homo sapiens
caggtgcagctggtgcagtctggggctgaggtgaagaggcctggggcctccgtgagggtcgcctgcaagacttctggttacacgttcaccgactaccatattcattgggtgcgacaggcccctggacaagggcttgagtggatgggatattttaaccctcgcactggtgagacagactatgcacagaaatttcaggacagaatcactatgactggggacgtgtccatgagcacagcctatttggagttgagcggactgagatctggcgacacggccgtctattactgtgcgaggccccttgccctgtattgtagtagttccaagtgttacacattgtgggctcttgatatctggggccagggacaatggtcaccgtctctgcag

SEQ ID NO: 197 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcaccagagatgcgactccgataactacggaatttgactactggggccagggaacactgatcaccgtctcctca

SEQ ID NO: 198 - DNA, 378 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagggatgcgactccgataactacggaatttgactactggggccagggaacactgatcaccgtctcctcacgcctccaccaacggccc

SEQ ID NO: 199 - DNA, 409 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccacgaaaacagtctacatggagttggagagcctgacatctggcgacacggccatgtatttctgcgccagagatgcgactccgataactacggaatttgactactggggccagggaacactgatcaccgtctcctcagcctccaccaagggcccatcggtcttcccccgtggccaccctcctccaa

SEQ ID NO: 200 - DNA, 363 bp, Homo sapiens
caggtgcagctggtgcagtctggggcagaggtgaagaagcctggggcctcagtgaaggtctcctgcgggacttctggatacaccttcaccaactactatatacattgggtgcggcaggccccctggacatgggcttgagtggatggcctggatcaaccctagcggtggtgccacaatctatgcagaggcttttgagggcaggtcaccgtaaccacggacacgtccatgaaaacagtctacatggagttggagagcctgacatctggcgacacggccatgtatttctgcgccagagatgcgactccgataactacggaattgaactactggggaccagggaacactgatcaccgtctcctcacg

SEQ ID NO: 201 - DNA, 363 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctca

SEQ ID NO: 202 - DNA, 414 bp, Homo sapiens
caggtgcagctggtgcagtctggggctgaggtgaagaggcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaggcccatcggtcttcccctcggccaccctcctccaacgacg

SEQ ID NO: 203 - DNA, 370 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggattggagcagcctgacatctggcgacacggccatgtatttctgcgccagagatgcgactccgataactacggaatttgactactggggccagggaacactgatcaccgtctcctcacgcctccacc

SEQ ID NO: 204 - DNA, 370 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatccatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccacc

SEQ ID NO: 205 - DNA, 400 bp, Homo sapiens
caggtgcagctggtgcagtctggggcagaggtgaagaagcctggggcctcagtgaaggcctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacggcccatccggtccttccccctcggcc

SEQ ID NO: 206 - DNA, 366 bp, Homo sapiens
caggtgcagctggtgcggtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgactcaccgtctcctcacgcct

SEQ ID NO: 207 - DNA, 359 bp, Homo sapiens
caggtgcagctggtgcagtctgggtcagaggtgaagaagcctggggcctcagtgaaggtctcctgcgggacttctggatacaccttcagtaatcactatatacattgggtgcgacaggcccctggacacgggcttgagtggatggcctggatcaatcctagcggtggtgccacaatctattcagagaattttgagggcagggtcaccgtaaccagggacacgtccatgaaaacagtctacatggaattgaacagtctgacatctggcgacacggccgtctattattgtgccagagatgcgactccaataactacggaatttgactactggggccagggacactgatcaccgtctcctca

SEQ ID NO: 208 - DNA, 372 bp, Homo sapiens
caggtgcagctggtgcagtctggggcagaggtgaagaagcctggggcctcagtgaaggtctcctgcgggacttctggatacgccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaa

SEQ ID NO: 209 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacgggcacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 210 - DNA, 380 bp, Homo sapiens
caggtgcagctggtgcagtctggggcagaggtgaagaagcctggggcctcagtgaaggtctcctgcgggacttctggatacaccttcaccaactactatatacaattgggtgcggcaggcccctggacatgggcttgagtggatggcctggatcaaccctagcggtggtgccacaatctatgcagaggcttttgagggcagggtcaccgtaacacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccgaacgggccc

SEQ ID NO: 211 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcgggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 212 - DNA, 369 bp, Homo sapiens
caggtgcagctggtgcggtctgggcctgccgtgaagaagcctgggacctcagtgaaggtctcctgtaaggcttctagatacagctttaccgccttctatatgcattgggtgcgacaggcccctagacatggccttgagtgggtgggatggatcgaaccgaacagtggtggcaccagttatggacagaggtttcagggcagggtgaccctgaccagggacgcgtccatcaacactttctacatggaattgagcagcctgacagatgacgactcggccgtttactactgtgcgagagatggtggtgggtccgcctttcacggaccctatgatctttggggtcaagggcactggtcaccgtctcttcagcct

SEQ ID NO: 213 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagagcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 214 - DNA, 416 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggtttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagggagtgcatcccgccctaacccttttccccctcgtcctcctctgacgaacttccc

SEQ ID NO: 215 - DNA, 359 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcggcacggccatgtatttctgcgccagagatgcgactccgataactacggaatttgactactggggccagggaacactgatcaccgtctcctc

SEQ ID NO: 216 - DNA, 379 bp, Homo sapiens
caggtgcagctggtgcagtctggagcagaggtgaaaaagccgggggagtctctgaaaatctcctgtaagggttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattattgtgcgagagagggactttgtagaactaccagctgccaatttgactactggggccagggcaccctggtcaccgtctcctcacgcctccaccgac

SEQ ID NO: 217 - DNA, 364 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcag

SEQ ID NO: 218 - DNA, 426 bp, Homo sapiens
caggtgcagctggtgcagtctggggcagaggtgaagaagcctggggcctcagtgaaggcctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaacggcccatccggtccttcccccgtcggccaccctcctcccaagacgccacctcgt

SEQ ID NO: 219 - DNA, 367 bp, Homo sapiens
caggtgcagctggtgcggtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgaggcggccgtttattattgtgcgagagactttagcgacggttggccttactccttcgacttctggggccagggaactctagtcaccgtctcctcagcct

SEQ ID NO: 220 - DNA, 355 bp, Homo sapiens
caggtgcagctgatgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacacggtcaccgtctc

SEQ ID NO: 221 - DNA, 383 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcaacggttggccttactccttcgacttctggggccagggaactctagtcaccgtctcctcacgcctccaccaacgggccca

SEQ ID NO: 222 - DNA, 417 bp, Homo sapiens
caggtgcagctggtgccgtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacgggcccatccggtccttccccctggccaccctcctccaacgacg

SEQ ID NO: 223 - DNA, 417 bp, Homo sapiens
caggtgcagctggtgcagtttggggctgaggtgaagaagcctgggtcctcggtgaaggtctcctgcaaggcttctggatacagcttcaccgactattatatacactgggtgcgacaggcccctggaaaacgtcttgagtgggtggggtggttcaatcctaagactggtggcgcgcactatggactggactatcagggcagagtgacgatgaccgggggcacgtccatcaccacagtctacatggagttgaccagattggcatccgacgacacggccatgtattattgtgcgagagaggagtttgagaactaccagctgccaattgacttctggggccagggaacgctggtcaccgtcttctcagcctccaccaacggccatccggtcttccccctcggccaccctcctccaacgacg

SEQ ID NO: 224 - DNA, 365 bp, Homo sapiens
caggtgcagctggtgcagtctgggtcagaggtgaagaagcctggggcctcagtgaaggtctcctgcgggacttctggatacaccttcagtaatcactatatacattgggtgcgacaggcccctggacacgggcttgagtggatggcctggatcaatcctagcggtggtgccacaatctattcagagaattttgagggcagggtcaccgtaaccagggacacgtccatgaaaacagtctacatggaattgaacagtctgacatctggcgacacggccgtctattattgtgccagagatgcgactccaataactacagaatttgactactggggccagggaacgctgatcaccgtctcctcacgcct

SEQ ID NO: 225 - DNA, 406 bp, Homo sapiens
  misc_feature (235)..(235): n is a, c, g, or t
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaaccngtctacatggagttggagagcctgacatctggcgacacggccatgtatttctgcgccagagatgcgactccggataactacggaatttgactacgtggggccagggaacactgatcaccgtctcctcacgcctccaccaacgggcccactccggtccttcccccgtcggcc

SEQ ID NO: 226 - DNA, 404 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctggcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaagggcccatccggtccttccccctcggccaccc

SEQ ID NO: 227 - DNA, 360 bp, Homo sapiens
caggtgcagctggtgcagtctggggcagaggtgaagaagcctggggtctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 228 - DNA, 379 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagaacctgacatctggcgacacggccatgtatttctgcgccagagatgcgactccgataactacggaatttgactactggggccagggaacactgatcaccgtctcctcacgcctccaccaacgggccc

SEQ ID NO: 229 - DNA, 352 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagtactttagcgtacggttggccttactccttcgacttcgtggggccagggaactcgta

SEQ ID NO: 230 - DNA, 439 bp, Homo sapiens
caggtgcagctggtgcaatctggggctgaggtgaagaagcctggggcctcagtgaaggtctcctgtaaggcttctagatacacggtaaacggccgctttatccactgggtgcgacaggcccctggacaagggctggagtggctgggttggatcaagcctaacagtgaaagcaccaactatgcatggaagtttcggggccgggtcagcatgaccggtgacacgtccatcaacacggtctacatggagttgagaagtctgagatctgacgacacggccgtatattactgcgcttcctgcgaccggcgtggtgggatttgcatcgatgtggaaggggggggctactacgctatggacgtctggggccaagggacctcggtcaccgtctcctcagcttccaccaagggcccatcggtcttccccctggcgccctgctccagga

SEQ ID NO: 231 - DNA, 383 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcacgcctccaccaacgggccca

SEQ ID NO: 232 - DNA, 365 bp, Homo sapiens
caggtgcagctggtgcagtcaggggctgaggtgaagaagcctgggtcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcct

SEQ ID NO: 233 - DNA, 362 bp, Homo sapiens
caggtgcagctggtgcagtctgggcctgaagtgaagaagcctggggcctcactgaaggtctcctgtaaggcctccggatacaccttcatcgattattatattcactgggtgcgacaagtccctggacaacggcttgagtggatgggttggatcaaccctaagacaactggcgcactctatgcagacaactttcagggtagggtcaccatgaccagggacacctccataagtacagcttacatggaattgaggaatctgagatctgaggacacggccgtgtactactgtgcgagatggggcgtggaattactatgataggtatggacgtcgtggggccaaggggacccacggtcaccgtctcc

SEQ ID NO: 234 - DNA, 490 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaaggcccatcggtcttccccctggcaccctcctccaacgacgcacctctggggcacagcggccctgggctgcctggtcaaggactacttcccgaaccggtgacggtgtcgtggaactc

SEQ ID NO: 235 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtagtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 236 - DNA, 367 bp, Homo sapiens
caggtgcagctggtgcagtctgggtcagaggtgaagaagcctggggcctcagtgaaggtctcctgcgggacttctggatacaccttcagtaatcactatatacattgggtgcgacaggcccctggacacgggcttgagtggatggcctggatcaatcctagcggtggtgccacaatctattcagagaattttgagggcagggtcaccgtaaccagggacacgtccatgaaaacagtctacatggaattgaacagtctgacatctggcgacacggccgtctattattgtgccagagatgcgactccaataactacagaatttgactactggggccagggaacgctgatcaccgtctcctcacgcctcc

SEQ ID NO: 237 - DNA, 365 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccacgtatttctgcgccagagatgcgactccgataactacggaatttgactactggggccagggaacactgatcaccgtctcctcacgcct

SEQ ID NO: 238 - DNA, 385 bp, Homo sapiens
caggtgcagctggtgcggtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaaggcccatcggtctt

SEQ ID NO: 239 - DNA, 371 bp, Homo sapiens
caggtgcagctggtgcagtctggggcagaggtgaagaagcctggggcctcagtgaaggtctcctgcgggacttctggatacaccttcatcaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctccgcctccaccaa

SEQ ID NO: 240 - DNA, 365 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctgggtcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaattgactacgtggggccagggaacactgatcaccgtctcctcacgcct

SEQ ID NO: 241 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 242 - DNA, 360 bp, Homo sapiens; identical to SEQ ID NO: 241

SEQ ID NO: 243 - DNA, 370 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccacc

SEQ ID NO: 244 - DNA, 360 bp, Homo sapiens; identical to SEQ ID NO: 241

SEQ ID NO: 245 - DNA, 362 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgcagagatgcgactccgataactacggaatttgactacgtggggccagggaacactgatcaccgtctcctcacg

SEQ ID NO: 246 - DNA, 370 bp, Homo sapiens; identical to SEQ ID NO: 243

SEQ ID NO: 247 - DNA, 364 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgactccaccgtctcctcacg

SEQ ID NO: 248 - DNA, 403 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcccccaccaacgggcccactccggtccttccccctcggcca

SEQ ID NO: 249 - DNA, 366 bp, Homo sapiens
caggtgcagctggtgcagtctgggcctgccgtgaagaagcctgggacctcagtgaaggtctcctgtaaggcttctagatacagctttaccgccttctatatgcattgggtgcgacaggcccctagacatggccttgagtgggtgggatggatcgaaccgaacagtggtggcaccagttatggacagaggtttcagggcagggtgaccctgaccagggacgcgtccatcaacactttctacatggaattgagcagcctgacagatgacgactcggccgtttactactgtgcgagagatggtggtgggtccgcctttcacggaccctatgatctttggggtcaagggacactggtcaccgtctcttca

SEQ ID NO: 250 - DNA, 360 bp, Homo sapiens; identical to SEQ ID NO: 241

SEQ ID NO: 251 - DNA, 426 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaacggcccactcggtccttccccctcggccaccctcctcccaacgacgccacctcgt

SEQ ID NO: 252 - DNA, 369 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccacc

SEQ ID NO: 253 - DNA, 443 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaaggcccatcggtcttccccctggcaccctcctccaagacgcacctctggggcacagcagccctggctgcctgg

SEQ ID NO: 254 - DNA, 415 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatccgacgagacggccgtttattattgtgcgagagactttagcgacggttggccttactccttcgacttctggggccagggaactctagtcaccgtctcctcagcctccaccaaggcccatcggtcttccccctggccaccctcctccaacgacg

SEQ ID NO: 255 - DNA, 370 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggatttgactacgtggggccagggaacactgatcaccgtctcctcacgcctccacc

SEQ ID NO: 256 - DNA, 362 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggactctagtcaccgtctcctca

SEQ ID NO: 257 - DNA, 370 bp, Homo sapiens; identical to SEQ ID NO: 243

SEQ ID NO: 258 - DNA, 379 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacggccca

SEQ ID NO: 259 - DNA, 360 bp, Homo sapiens; identical to SEQ ID NO: 241

SEQ ID NO: 260 - DNA, 365 bp, Homo sapiens; identical to SEQ ID NO: 184

SEQ ID NO: 261 - DNA, 374 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaa

SEQ ID NO: 262 - DNA, 370 bp, Homo sapiens; identical to SEQ ID NO: 243

SEQ ID NO: 263 - DNA, 360 bp, Homo sapiens; identical to SEQ ID NO: 241

SEQ ID NO: 264 - DNA, 360 bp, Homo sapiens; identical to SEQ ID NO: 241

SEQ ID NO: 265 - DNA, 380 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacgggccca

SEQ ID NO: 266 - DNA, 379 bp, Homo sapiens; identical to SEQ ID NO: 258

SEQ ID NO: 267 - DNA, 365 bp, Homo sapiens
  misc_feature (347)..(347): n is a, c, g, or t
caggtgcagctggtgcagtctggggttgaggtgaagaaacctggggcctcaatgaaggtctcctgcaaggcttctggatacagcttcaccgactattatatacactgggtgcgacaggcccctggaaaacgtcttgagtgggtggggtggttcaatcctaagactggtggcgcgcactatggactggactatcagggcagagtgacgatgaccggggacacgtccatcaccacagtctacatggagttgaccagattggcatccgacgacacggccatgtattattgtgcgagagagggagtttgtagaactaccagctgccaatttgacttctggggccagggacnctggtcaccgtcttctca

SEQ ID NO: 268 - DNA, 372 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccacc

SEQ ID NO: 269 - DNA, 373 bp, Homo sapiens
caggtgcagctggtgcagtctggggctgagatgaagaagcctggggcctcagtgagggtctcctgcagggcttctggatacagtctcagcgactatgggatgcactgggtgcgacaggcccctggacaagggcttgagtggatgggatggatcagacaaaacagtggtggcgcaacctatgcacagaaatttcaaggcagagtcatcatgagtagggacacgtccatcactacagacttcatagaactgagtagcctgacacttgacgacacggccgtatactattgtgcgagagcccagaggccagtggctgacgcacttgaacttgactattggggccagggaacactggtcaccgtctcgtcagcctcca

SEQ ID NO: 270 - DNA, 360 bp, Homo sapiens; identical to SEQ ID NO: 241

SEQ ID NO: 271 - DNA, 362 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacg

SEQ ID NO: 272 - DNA, 360 bp, Homo sapiens
caggtgcagctggtgcagtctggggctgaggtgaagaagcctggggcctcagtgaaggtctcctgcgggacttctggatacaccttcaccaacgactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 273 - DNA, 372 bp, Homo sapiens; identical to SEQ ID NO: 268

SEQ ID NO: 274 - DNA, 365 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaacacagtctacatggagttggagagcctgacatctggcgacacggccatgtattactgcgccagagatgcgactccgataacctacggaattgactactggggccagggaacactgatcaccgtctcctcacgcct

SEQ ID NO: 275 - DNA, 422 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacggcccactcggtccttccccctcggccaccctcctccaacgacgccacc

SEQ ID NO: 276 - DNA, 360 bp, Homo sapiens
caggtgcagctggtgcagtctgggtctgaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 277 - DNA, 370 bp, Homo sapiens
caggtgcagctggtgcagtctggaggagaggtgaagacgcctggggcctcagtgaaagtctcctgcaggacttcaggatacaccttcaccgcttactacatacactgggtgcgacaggcccctggacacgggcttgagtgggtggggtggatcaaccccagtggaggtgccacaatctatgcacagaagtttgagggcagggtcaccttgaccagcgacacgtccattagtacagcctatttggagttgagcaacctgagacctgacgacacggccacatattattgtgtaagagatgcgactccggtgacaacggaattcgacttctggggccagggagcgctggtcaccgtctcctcacgcctccacc

SEQ ID NO: 278 - DNA, 367 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctcc

SEQ ID NO: 279 - DNA, 440 bp, Homo sapiens
caggtgcagctggtgcagtctggggctgaggtgaagaggcctggggcctcagtgagggtcgcctgcaagacttctggttacacattcaccgactaccatattcattgggtgcgacaggcccctggacaagggcttgagtggatgggatatttcaaccctcgcactggtgagacagactatgcacagagatttcaggacagaatcactatgactggggacgtgtccatgagcacagcctatatggagttgagcggactgagatctggcgacacggccgtctattactgtgcgaggccccttgccctgtattgtagtagttccaagtgctacacattgtgggctcttgatatctggggccaggggacaatggtcaccgtctctgcatcttccaccaagggcccatcggtcttccccctggcgccctgctccaggacgcacct

SEQ ID NO: 280 - DNA, 360 bp, Homo sapiens; identical to SEQ ID NO: 241

SEQ ID NO: 281 - DNA, 420 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaattgactacgtggggccagggaacactgatcaccgtctcctcacgcctccaccgaacggcccactccggtccttccccctcggccaccctcctaccaacgacg

SEQ ID NO: 282 - DNA, 367 bp, Homo sapiens; identical to SEQ ID NO: 278

SEQ ID NO: 283 - DNA, 346 bp, Homo sapiens
caggtgcagctggtgcagtctggggctgaactgaggaagtctggggcctcagcgaaggtctcctgcacggccactggatacacctccaccgcctattatgtacactgggtgcgacaggcccctggacaaggtcttgggtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtccaccgtttcc

SEQ ID NO: 284 - DNA, 403 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccgaacggcccactccggtccttcccccgtcggcc

SEQ ID NO: 285 - DNA, 360 bp, Homo sapiens; identical to SEQ ID NO: 241

SEQ ID NO: 286 - DNA, 363 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctca

SEQ ID NO: 287 - DNA, 360 bp, Homo sapiens; identical to SEQ ID NO: 241

SEQ ID NO: 288 - DNA, 363 bp, Homo sapiens; identical to SEQ ID NO: 286

SEQ ID NO: 289 - DNA, 403 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacggcccatcggtccttccccctcggccaccc

SEQ ID NO: 290 - DNA, 360 bp, Homo sapiens; identical to SEQ ID NO: 241

SEQ ID NO: 291 - DNA, 363 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaattgactacgtggggaccagggaacactgatcaccgtctcctcacg

SEQ ID NO: 292 - DNA, 365 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggtccagggaactctagtcaccgtctcctcag

SEQ ID NO: 293 - DNA, 402 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacggcccactccggtccttcccccgtcggcc

SEQ ID NO: 294 - DNA, 360 bp, Homo sapiens; identical to SEQ ID NO: 241

SEQ ID NO: 295 - DNA, 365 bp, Homo sapiens
caggtgcagctggtgcagtctggggcagaggtgaagaagcctggggcctcagtgaaggtcccctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgtgccagagatgcgactccgataactacggaatttgactactggggccagggaacactgatcaccgtctcctcacgcct

SEQ ID NO: 296 - DNA, 366 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcccc

SEQ ID NO: 297 - DNA, 365 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaaacagtctacatggagttggagagcctgacatctggcgacacggccatgtatttctgacgccagagatgcgactccgataactacggaatttgactacgtggggccagggaacactgatcaccgtctcctcacg

SEQ ID NO: 298 - DNA, 363 bp, Homo sapiens; identical to SEQ ID NO: 286

SEQ ID NO: 299 - DNA, 364 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcc

SEQ ID NO: 300 - DNA, 373 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaac

SEQ ID NO: 301 - DNA, 417 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacggcccatcggtccttccccctcggccaccctcctaccaacgacg

SEQ ID NO: 302 - DNA, 360 bp, Homo sapiens; identical to SEQ ID NO: 241

SEQ ID NO: 303 - DNA, 370 bp, Homo sapiens; identical to SEQ ID NO: 243

SEQ ID NO: 304 - DNA, 360 bp, Homo sapiens; identical to SEQ ID NO: 241

SEQ ID NO: 305 - DNA, 364 bp, Homo sapiens; identical to SEQ ID NO: 299

SEQ ID NO: 306 - DNA, 370 bp, Homo sapiens; identical to SEQ ID NO: 243

SEQ ID NO: 307 - DNA, 360 bp, Homo sapiens; identical to SEQ ID NO: 241

SEQ ID NO: 308 - DNA, 354 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtgaccacggacacgtccatgaaaacagtctacatggagttggagagcctgacatctggcgacacggccatgtatttctgcgccagagatgcgactccgataactacggaatttgactactggggccagggaacactgatcaccgtc

SEQ ID NO: 309 - DNA, 393 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccgaaggcccatccggtccttccccc

SEQ ID NO: 310 - DNA, 412 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccacggcccatcggtcttccccctcggcaccctcctccaacgacg

SEQ ID NO: 311 - DNA, 363 bp, Homo sapiens; identical to SEQ ID NO: 286

SEQ ID NO: 312 - DNA, 360 bp, Homo sapiens; identical to SEQ ID NO: 241

SEQ ID NO: 313 - DNA, 443 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaacggcccatccggtccttccccctggccaccctcctcccaagacgccacctcgtcggggcacgacgcacgccc

SEQ ID NO: 314 - DNA, 363 bp, Homo sapiens
caggtgcagctggtgcagtctggggctgaggtgaagaagcctggggcctcaatgagggtctcatgccagacttcaggatacacgtttaactcctattatatacactggatgcgccaggtccctggacaaggccttgagtggatgggatggattagccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctca

SEQ ID NO: 315 - DNA, 360 bp, Homo sapiens; identical to SEQ ID NO: 241

SEQ ID NO: 316 - DNA, 360 bp, Homo sapiens; identical to SEQ ID NO: 241

SEQ ID NO: 317 - DNA, 372 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccacc

SEQ ID NO: 318 - DNA, 380 bp, Homo sapiens; identical to SEQ ID NO: 265

SEQ ID NO: 319 - DNA, 452 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacgggcccacgtccggtccttcccccgtcggccaccctcctccaacgacgccacctcgtcggggccacgacgcacgcccgt

SEQ ID NO: 320 - DNA, 370 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgcagagatgcgactccgataactacggaatttgactacgtggggccagggaacactgatcaccgtctcctcacgcctccacc

SEQ ID NO: 321 - DNA, 423 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaaggcccatcggtcttcccctggcacctcctccaagacgcacctctggggc

SEQ ID NO: 322 - DNA, 373 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggctacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggaccagggaactctagtcaccgtctcctcagcctccacc

SEQ ID NO: 323 - DNA, 419 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcacgcctccaccaacggcccatccggtcttccccctcggccaccctcctccaacgacg

SEQ ID NO: 324 - DNA, 428 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacgggcccatccggtccttccccctcggccaccctccctccaacgacgccacctcgt

SEQ ID NO: 325 - DNA, 406 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagggagtgcactcccgcccctaacccttttccccctcgtcctcctct

SEQ ID NO: 326 - DNA, 360 bp, Homo sapiens; identical to SEQ ID NO: 241

SEQ ID NO: 327 - DNA, 367 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcacgcc

SEQ ID NO: 328 - DNA, 363 bp, Homo sapiens; identical to SEQ ID NO: 286

SEQ ID NO: 329 - DNA, 362 bp, Homo sapiens; identical to SEQ ID NO: 271

SEQ ID NO: 330 - DNA, 349 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatca

SEQ ID NO: 331 - DNA, 370 bp, Homo sapiens; identical to SEQ ID NO: 243

SEQ ID NO: 332 - DNA, 360 bp, Homo sapiens; identical to SEQ ID NO: 241

SEQ ID NO: 333 - DNA, 356 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgt

SEQ ID NO: 334 - DNA, 370 bp, Homo sapiens; identical to SEQ ID NO: 243

SEQ ID NO: 335 - DNA, 360 bp, Homo sapiens; identical to SEQ ID NO: 241

SEQ ID NO: 336 - DNA, 365 bp, Homo sapiens; identical to SEQ ID NO: 184

SEQ ID NO: 337 - DNA, 360 bp, Homo sapiens; identical to SEQ ID NO: 241

SEQ ID NO: 338 - DNA, 370 bp, Homo sapiens; identical to SEQ ID NO: 243

SEQ ID NO: 339 - DNA, 360 bp, Homo sapiens; identical to SEQ ID NO: 241

SEQ ID NO: 340 - DNA, 379 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaattcgactactggggccagggaacactgatcaccgtctcctcagcctccaccaacgggccca

SEQ ID NO: 341 - DNA, 364 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgcagagatgcgactccgataactacggaatttgactacgtggggccagggaacactgatcaccgtctcctcacgcc

SEQ ID NO: 342 - DNA, 404 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaattcgactactggggccagggaacactgatcaccgtctcctcacgcctccaccaacgggcccactccggtccttcccccgtcggcca

SEQ ID NO: 343 - DNA, 371 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactcgtagtcaccgtctcctcacgcctcc

SEQ ID NO: 344 - DNA, 360 bp, Homo sapiens; identical to SEQ ID NO: 241

SEQ ID NO: 345 - DNA, 360 bp, Homo sapiens; identical to SEQ ID NO: 241

SEQ ID NO: 346 - DNA, 379 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaggccca

SEQ ID NO: 347 - DNA, 370 bp, Homo sapiens; identical to SEQ ID NO: 243

SEQ ID NO: 348 - DNA, 363 bp, Homo sapiens; identical to SEQ ID NO: 286

SEQ ID NO: 349 - DNA, 355 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtct

SEQ ID NO: 350 - DNA, 360 bp, Homo sapiens; identical to SEQ ID NO: 241

SEQ ID NO: 351 - DNA, 416 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaacggcccactcggtccttccccctcggccaccctcctccaacgacg

SEQ ID NO: 352 - DNA, 410 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaacgggcccatccggtccttccccctggccgccctgcctcc

SEQ ID NO: 353 - DNA, 369 bp, Homo sapiens; identical to SEQ ID NO: 252

SEQ ID NO: 354 - DNA, 380 bp, Homo sapiens; identical to SEQ ID NO: 265

SEQ ID NO: 355 - DNA, 362 bp, Homo sapiens; identical to SEQ ID NO: 271

SEQ ID NO: 356 - DNA, 360 bp, Homo sapiens; identical to SEQ ID NO: 241

SEQ ID NO: 357 - DNA, 360 bp, Homo sapiens; identical to SEQ ID NO: 241

SEQ ID NO: 358 - DNA, 406 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccgaaggcccatcggtccttccccctcggccaccctcc

SEQ ID NO: 359 - DNA, 364 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcct

SEQ ID NO: 360 - DNA, 360 bp, Homo sapiens; identical to SEQ ID NO: 241

SEQ ID NO: 361 - DNA, 360 bp, Homo sapiens; identical to SEQ ID NO: 241

SEQ ID NO: 362 - DNA, 370 bp, Homo sapiens; identical to SEQ ID NO: 243

SEQ ID NO: 363 - DNA, 403 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccgaacggcccagtccggtccttcccccgtcggcc

SEQ ID NO: 364 - DNA, 365 bp, Homo sapiens; identical to SEQ ID NO: 184

SEQ ID NO: 365 - DNA, 400 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagggatgcactcccgcccctaacccttttccccctcgtcct

SEQ ID NO: 366 - DNA, 373 bp, Homo sapiens; identical to SEQ ID NO: 300

SEQ ID NO: 367 - DNA, 366 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaattgactacgtggggaccagggaacactgatcaccgtctcctcacgcct

SEQ ID NO: 368 - DNA, 346 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactga

SEQ ID NO: 369 - DNA, 365 bp, Homo sapiens; identical to SEQ ID NO: 184

SEQ ID NO: 370 - DNA, 382 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctatctggagctcagtgccctgagatctgacgagacggccgtttattattgtgcgagagactttagcgacggttggccttactccttcgacttctggggccagggaactctagtcaccgtctcctcagcctccaccaacgggccca

SEQ ID NO: 371 - DNA, 360 bp, Homo sapiens; identical to SEQ ID NO: 241

SEQ ID NO: 372 - DNA, 362 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataacctacggaattgactactggggccagggaacactgatcaccgtctcctcacg

SEQ ID NO: 373 - DNA, 380 bp, Homo sapiens; identical to SEQ ID NO: 265

SEQ ID NO: 374 - DNA, 348 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatc

SEQ ID NO: 375 - DNA, 365 bp, Homo sapiens; identical to SEQ ID NO: 184

SEQ ID NO: 376 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaaacagtctacatggagttggagagcctgacatctgcgacacggccatgtatttctgcgccagagatgcgactccgataactacggaatttgactactggggccagggaacactgatcaccgtctcctca

SEQ ID NO: 377 - DNA, 346 bp, Homo sapiens; identical to SEQ ID NO: 368

SEQ ID NO: 378 - DNA, 405 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaacggcccatccggtccttcccccgtcggccaccct

SEQ ID NO: 379 - DNA, 415 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaaggcccatcggtccttccccctcggccaccctcctccaacgacg

SEQ ID NO: 380 - DNA, 360 bp, Homo sapiens; identical to SEQ ID NO: 241

SEQ ID NO: 381 - DNA, 363 bp, Homo sapiens; identical to SEQ ID NO: 286

SEQ ID NO: 382 - DNA, 367 bp, Homo sapiens; identical to SEQ ID NO: 278

SEQ ID NO: 383 - DNA, 362 bp, Homo sapiens; identical to SEQ ID NO: 271

SEQ ID NO: 384 - DNA, 414 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttgttattgtgcgagagactttagcgacggttggccttactccttcgacttctggggccagggaactctagccaccgtctcctcagcctccaccaaggcccatcggtcttcccctggccaccctcctccaacgacg

SEQ ID NO: 385 - DNA, 363 bp, Homo sapiens; identical to SEQ ID NO: 201

SEQ ID NO: 386 - DNA, 362 bp, Homo sapiens; identical to SEQ ID NO: 271

SEQ ID NO: 387 - DNA, 360 bp, Homo sapiens; identical to SEQ ID NO: 241

SEQ ID NO: 388 - DNA, 452 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaagggcccatcggtcttccccctggccaccctcctccaacgacgcacctctgggggcacagcagccctgggctgcctggtcaa

SEQ ID NO: 389 - DNA, 452 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatccgacgagacggccgtttattattgtgcgagagactttagcgacggttggccttactccttcgacttctggggccagggaactctagtcaccgtctcctcagcctccaccaagggcccatcggtcttccccctggccaccctcctccaacgacgcacctctggggcacagcggccctgggctgcctggtc

SEQ ID NO: 390 - DNA, 360 bp, Homo sapiens; identical to SEQ ID NO: 241

SEQ ID NO: 391 - DNA, 372 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaa

SEQ ID NO: 392 - DNA, 362 bp, Homo sapiens; identical to SEQ ID NO: 271

SEQ ID NO: 393 - DNA, 376 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaaggccc

SEQ ID NO: 394 - DNA, 362 bp, Homo sapiens; identical to SEQ ID NO: 271

SEQ ID NO: 395 - DNA, 344 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaaccagtctacatggagttggagagcctgacatctggcgacacggccatgtatttctgcgccagagatgcgactccgaataactacggaatttgactacgtggggccagggaac

SEQ ID NO: 396 - DNA, 346 bp, Homo sapiens; identical to SEQ ID NO: 368

SEQ ID NO: 397 - DNA, 386 bp, Homo sapiens
caggtgcagctggtgcagtctggggctgaagtgaagaagcctggggcctcagtgagggcctcctgcagggcttctggatacagtctcagcgactatgggatgcactgggtgcgacaggcccctggacaagggcttgagtggatgggatggatcaaacaaaacagtggtggcgcaacctatgcacagaaatttcaaggcagagtcatcatgagtagggacacgtccatcactacagacttcatagaactgagtagcctgacacttgacgacacggccgtatactattgtgcgagagcccagaggccagtggctgacgcacttgaacttgactattggggccgagggaacactggtcaccgtctcgtcagcctccaccaacgggccca

SEQ ID NO: 398 - DNA, 370 bp, Homo sapiens; identical to SEQ ID NO: 243

SEQ ID NO: 399 - DNA, 378 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacggccc

SEQ ID NO: 400 - DNA, 418 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaacgggcccatccggtcttccccctcggccaccctcctccaacgacgcc

SEQ ID NO: 401 - DNA, 361 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcag

SEQ ID NO: 402 - DNA, 365 bp, Homo sapiens; identical to SEQ ID NO: 184

SEQ ID NO: 403 - DNA, 370 bp, Homo sapiens; identical to SEQ ID NO: 243

SEQ ID NO: 404 - DNA, 363 bp, Homo sapiens; identical to SEQ ID NO: 286

SEQ ID NO: 405 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgtcacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 406 - DNA, 426 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaaggcccatcggtcttcccctggcaccctcctccaagacgcacctctggggcac

SEQ ID NO: 407 - DNA, 360 bp, Homo sapiens; identical to SEQ ID NO: 241

SEQ ID NO: 408 - DNA, 370 bp, Homo sapiens; identical to SEQ ID NO: 243

SEQ ID NO: 409 - DNA, 370 bp, Homo sapiens; identical to SEQ ID NO: 243

SEQ ID NO: 410 - DNA, 360 bp, Homo sapiens; identical to SEQ ID NO: 241

SEQ ID NO: 411 - DNA, 414 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaagggcccatccggtcttccccctggccaccctcctccaacg

SEQ ID NO: 412 - DNA, 360 bp, Homo sapiens; identical to SEQ ID NO: 241

SEQ ID NO: 413 - DNA, 367 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcct

SEQ ID NO: 414 - DNA, 346 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgggtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtccaccgtttcc

SEQ ID NO: 415 - DNA, 362 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctc

SEQ ID NO: 416 - DNA, 363 bp, Homo sapiens; identical to SEQ ID NO: 201

SEQ ID NO: 417 - DNA, 374 bp, Homo sapiens; identical to SEQ ID NO: 261

SEQ ID NO: 418 - DNA, 415 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaaggcccatcggtcttccccctggccaccctcctccaacgacg

SEQ ID NO: 419 - DNA, 363 bp, Homo sapiens; identical to SEQ ID NO: 201

SEQ ID NO: 420 - DNA, 364 bp, Homo sapiens
caggtgcagctggtgcagtctggggctgaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcct

SEQ ID NO: 421 - DNA, 380 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagttccaggacagagtcacctttaccacggacgaatccaagactacagcctacatggaactgagaagcctgagatctgaggacacggccgtctattactgtgcgagaaataccggcgcagtggctacctctttgtacagtttgggcgtctggggccaagggaccacggtcgccgtctcctcagcctccaccaa

SEQ ID NO: 422 - DNA, 459 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaagggcccatcggtcttccccctggcaccctcctccaagagcacctctggggcacacgcggccctgggctgcctggtcaaggactac

SEQ ID NO: 423 - DNA, 374 bp, Homo sapiens; identical to SEQ ID NO: 261

SEQ ID NO: 424 - DNA, 348 bp, Homo sapiens
caggtgcagctggtgcagtctgaggctgaagtgaagaaacctggggcctcaatgaaggtctcctgtaaggcttctggatatagtttcaccgactattatatttattgggtgcgacaggtccccggacaaggactcgagtggatgggatggatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctca

SEQ ID NO: 425 - DNA, 362 bp, Homo sapiens; identical to SEQ ID NO: 256

SEQ ID NO: 426 - DNA, 363 bp, Homo sapiens
caggtgcagctggtgcagtctggggctgaggtgaagaagcctggggcctcaatgagggtctcatgtcagacttcgggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttgccttactccttcgacttcgtggggccagggaactctagtcaccgtctcctca

SEQ ID NO: 427 - DNA, 374 bp, Homo sapiens; identical to SEQ ID NO: 261

SEQ ID NO: 428 - DNA, 459 bp, Homo sapiens
caggtgcagctggtgcagtctggggctgaggtgaagaagcctgggtcctcggtgaaggtctcctgcaaggcttctggaggcaccttcagcgactacggtgttcattgggtgcgacaggcccctggacaaggccttgagtggatggggtggatcaatcatttcagtggtggcgccacatacgcagaggtatttcagggccgggtcgccatgaccagggacacgtccatcaacacagccttcatggaactgagaagtctgaaatttgacgacacggccttatattactgtgcgagagcccagaggccagtggctgacgcccttgagctcgacttgtggggccagggaacgctggtcaccgtctcgtcagcctccaccaagggcccatcggtcttccccctggccaccctcctccaggacgcacctccgagagcacagcggccctgggctgcctggtcaagg

SEQ ID NO: 429 - DNA, 363 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactcttgtcaccgtctcctca

SEQ ID NO: 430 - DNA, 433 bp, Homo sapiens
caggtgcagctggtgcagtctggggctgaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccaacggcccactccggtccttccccctcggccaccctcctcccaacgacgccacctcgtcgggg

SEQ ID NO: 431 - DNA, 425 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaggccatcggtcttcccctggcaccctcctccaagacgcacctctcggggcac

SEQ ID NO: 432 - DNA, 363 bp, Homo sapiens; identical to SEQ ID NO: 286

SEQ ID NO: 433 - DNA, 369 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggatggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctcc

SEQ ID NO: 434 - DNA, 382 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaacgggccca

SEQ ID NO: 435 - DNA, 380 bp, Homo sapiens
caggtgcagctggtgcagtctggggctgaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcctccaccgaacggccca

SEQ ID NO: 436 - DNA, 416 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaacggcccatcggtcttccccctggccaccctcctccaacgacg

SEQ ID NO: 437 - DNA, 375 bp, Homo sapiens
caggtgcagctggtgcagtctggggctgaggtgaagaagcctggggcctcagtgaaggtctcctgtaagacttccggatacaccttcaccagttacgatgttaattgggtgcgacaggcccctggacaacgtcttgagtggataggatggttcaatcctaacactggtggcgcacactatggactggactatcagggcagagtgacgatgaccggggacacgtccatcaccacagtctacatggagttgaccagactggcatccgacgacacggccatttattattgtgcgagagagggactttgtagaactactagctgccaatttgacttctggggccagggaacgctggtcaccgtcttctcagcctccacc

SEQ ID NO: 438 - DNA, 364 bp, Homo sapiens; identical to SEQ ID NO: 217

SEQ ID NO: 439 - DNA, 382 bp, Homo sapiens; identical to SEQ ID NO: 434

SEQ ID NO: 440 - DNA, 364 bp, Homo sapiens; identical to SEQ ID NO: 217

SEQ ID NO: 441 - DNA, 428 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccaccaaggcccatcggtcttccccctggccaccctcctccaagacgcacctctggggcac

SEQ ID NO: 442 - DNA, 363 bp, Homo sapiens; identical to SEQ ID NO: 286

SEQ ID NO: 443 - DNA, 372 bp, Homo sapiens; identical to SEQ ID NO: 268

SEQ ID NO: 444 - DNA, 377 bp, Homo sapiens
caggtgcagctggtgcagtctggggctgaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcagcctccaccaaggccca

SEQ ID NO: 445 - DNA, 369 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagttccaggacagagtcacctttaccacggacgaatccaagactacagcctacatggaactgagaagcctgagatctgaggacacggccgtctattactgtgcgagaaataccggcgcagtggctacctctttgtacagtttgggcgtctggggccaagggaccacggtcgccgtctcctca

SEQ ID NO: 446 - DNA, 362 bp, Homo sapiens; identical to SEQ ID NO: 415

SEQ ID NO: 447 - DNA, 364 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatggggtggattaaccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcag

SEQ ID NO: 448 - DNA, 416 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccgtgtatttctgcgccagagatgcgactccgataactacggaatttgactactggggccagggaacactgatcaccgtctcctcacgcctccaccaacggcccatcggtccttccccctcggccaccctcctccaacgacg

SEQ ID NO: 449 - DNA, 372 bp, Homo sapiens; identical to SEQ ID NO: 268

SEQ ID NO: 450 - DNA, 360 bp, Homo sapiens
caggtgcagctggtgcagtctggggcagaggtgaagaagcctggggcctcagtgaaggtctcctgcgggacttctggatacaccttcaccaactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccgtgtatttctgcgccagagatgcgactccgataactacggaatttgactactggggccagggaacactgatcaccgtctcctca

SEQ ID NO: 451 - DNA, 382 bp, Homo sapiens; identical to SEQ ID NO: 434

SEQ ID NO: 452 - DNA, 359 bp, Homo sapiens
caggtgcagctggtgcagtctggggctgaggtgaagacgcctggggcctcagtgaaagtctcctgcaggacttcaggatacaccttcaccgcttactacatacactgggtgcgacaggccctcggacacgggcttgagtgggtggggtggatcaaccccagtggaggtgccacaatctatgcacagaagtttgagggcagggtcaccttgaccagcgacacgtccattagtacagcctatttggagttgagcaacctgagacctgacgacacggccacatattattgtgtaagagatgcgactccggtgacaacggaattcgacttctggggccagggagcgctggtcaccgtctcctc

SEQ ID NO: 453 - DNA, 375 bp, Homo sapiens
caggtgcagctggtgcagtctgggcctgaagtgaagaagcctggggcctcactgaaggtctcctgtaaggcctccgaatacaccttcatcgattattatattcactgggtgcgacaagtccctggacaacggcttgagtggatgggttggatcaaccctaagacaactggcgcactctatgcagacaactttcagggtagggtcaccatgaccagtgacacgtccatcaacacagtctacatggaagtgaccaggctgacatctgacgacacggccgtttacttctgtgcgagagagggacattgcagtagtaccaattgtttctttgactcttggggccagggaaccctggtcaccgtctcctccgcctccacc

SEQ ID NO: 454 - DNA, 372 bp, Homo sapiens
caggtgcagctggtgcagtctggggctgaggtgaagaagcctggggcctcaatgagggtctcatgtcagacttcaggatacacgtttaactcctattatatacactggatgcgccaggtccctggacaaggccttgagtggatgggtggattaacccctaatagtggttacacaaactatacacagaaatttcagggaagggtcaccatgaccagggatacgtccattaacacagcctacctggagctcagtgccctgagatctgacgagacggccgtttattattgtgcgagagactttagcgacggttggccttactccttcgacttctggggccagggaactctagtcaccgtctcctcagcctccacc

SEQ ID NO: 455 - DNA, 348 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtccaccgtttcctc

SEQ ID NO: 456 - DNA, 337 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcagggggaggtcaccatgaccagggacacgtccaccaatacagcctacatggaactgagtggactgacatttgacgacacggccatgtattattgcctcactgcaatagatgggatcgtctactggggccagggacccctggtcc

SEQ ID NO: 457 - DNA, 365 bp, Homo sapiens
caggtgcagctggtgcagtctggggctgaagtgaagaggcctggggcctcagtgagagtctcctgcaggacttctggatactcctttaccgcctattatatacactgggttcgacaggcccctggacaggggcttgagtggatgggaaggctcaaccctaacactggtggcgcagactcttcacagaagtttcagggcagagtcaccttgacccgggacacgtccatcaacacagcctacatggatctgaggaggctaagagttgacgactcggccacctattattgcgcgagcggcatacaggcaggtggtgcaaactactggggccagggaaccctggtcaccgtctcctccgcttccaccaa

SEQ ID NO: 458 - DNA, 366 bp, Homo sapiens
  misc_feature (348)..(348): n is a, c, g, or t
caggtgcagctgggacaatctggggctgaaatgaagaagcctggggcctcagtgatgctctcctgcaagacttctggatacaacttcatcgactactatatatactgggtgcgactggcccctggacgagggcttcagtggatgggatggataaaccctaacagaggtggcacaaagtatgcggagacctttcgggacaggctcaccatgaccagggacacgcccgtcagcacggcctatatggagctgaacaacctgagatctgacgacacggccgtctactactgtgcgagacttcaaagccttcatgggctttactctaacgctgactactggggccagggaacnctggtcaccgtctcctca

SEQ ID NO: 459 - DNA, 376 bp, Homo sapiens
caggtgcagctggtgcagtctgggcctgaagtgaagaagcctggggcctcactgaaggtctcctgtaaggcctccggatacaccttcatcgattattatattcactgggtgcgacaagtccctggacaacggcttgagtggatgggttggatcaaccctaagacaactggcgcactctatgcagacaactttcagggtagggtcaccatgaccagtgacacgtccatcaacacagtctacatggaggtgaccaggctgacatctgacgacacggccgtttactactgtgcgagagagggacattgcagtagtaccaattgtttcttgactcgttggggccagggaaccctggtcaccgtctcctcacgcctccacc

SEQ ID NO: 460 - DNA, 346 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtccaccgtttcc

SEQ ID NO: 461 - DNA, 365 bp, Homo sapiens
caggtgcagctggtgcagtctgggactgacgtgcggaagcctggggcctcagtgaaggtctcctgcaaggcttctggatacaccttcagcgactactatatacactgggtgcgacaggcccctggacaacgtcttgagtggataggatggttcaatcctaacactggtggcgcacactatggactggactatcagggcagagtgacgatgaccggggacacgtccatcaccacagtctacatggagttgaccagactggcatccgacgacacggccatttattattgtgcgagagagggactttgagaactactagctgccaatttgacttcgtggggccagggacgctggtcaccgtcttctca

SEQ ID NO: 462 - DNA, 372 bp, Homo sapiens
caggtgcagctggtgcagtctggggctgaggtgaagaggcctggggcctcagtgagagtctcctgcaaggcttctggttactcctttaccgcctactttttgcactgggtgcgacaggcccctggacaagggcttgagtttatgggaaggctcaaccctaatactggtgccacagactttccacagaagtttcagggcagggtcaccgtgaccagggacacgtccattagcacagcctacatggaagtttatggactgagacctgaagacacggccgtctattattgtgcggccggaatacaggcaggtggtgcaaactactggggccagggaaccctggtcaccgtctcctccgcttccaccaagggccca

SEQ ID NO: 463 - DNA, 344 bp, Homo sapiens
caggtgcagctggtgcagtctggggctgaggtgaagacgcctggggcctcagtgaaagtctcctgcaggacttcaggatacaccttcaccgcttactacatacactgggtgcgacaggcccctggacacgggcttgagtgggtggggtggatcaattgtaacagtgccggcacattttatgcacagaagtttcagggcagggtcatcatgacgagggacacgtccaacaacactgtctacatgcaactgaatagcctgaattcagacgacacggccgtctattattgtgcgagagtgacgtcccccggagtctggggcaaggggaccacggtcaccgtctcttc

SEQ ID NO: 464 - DNA, 406 bp, Homo sapiens
caggtgcagctggtgcagtctggggctgaggtgaagaagcctggggcctcagtgaaggtctcctgcaaggcttctggatacaccttcaccgactactatctacactgggtgcggcaggcccctggacaagggcttgagtggatgggatggatcatgcctaacactggtggcgtacattcctcaccgaaatttcaggggagattctccgtgactagggacacgtcaaccagcacagcctacatgcaattgagtcgactgacatctgacgacacggccgtatactattgtgcgagaactgacggggactttattgactactggggccagggaacgctggtcaccgtctcgtcagcctccaccaagggcccatcggtcttcccctggcgccctgcctccaggacgcacc

SEQ ID NO: 465 - DNA, 378 bp, Homo sapiens
caggtgcagctggtgcagtctgggactgaggtgaggaatcctggggcctcagtgaaggtctcctgtaaggcttctggatataggttcaccgactattttatacactggatgcgacaggcccctggacaggggcttgagtggatgggatggatcgacccgcacggtggtggcacaaactacgcacagaagtttcagggcagggtcaccttggtgcgggacgcgtccatttccatggcctacatggaactgagcagcctgacatctgacgacacggccctatacttctgtgcgagagaagtggacacatctctagatttacttatctactacatggacgtctggggcaaagggccacggtcaccgtctcctcagggagtg

SEQ ID NO: 466 - DNA, 420 bp, Homo sapiens
caggtgcagctggtgcagtctgggcctgaagtgaagaagcctggggcctcactgaaggtctcccgtaaggcctccggatacaccttcatcgattattatattcactgggtgcgacaagtccctggacaacggcttgagtggatgggttggatcaaccctaagacaactggcgcactctatgcagacaactttcagggtagggtcaccatgaccagtgacacgtccatcaacacagtctacatggaggtgaccaggctgacatctgacgacacggccgtttactactgtgcgagagagggacattgcagtagtaccaattgtttctttgactcttggggccagggaaccctggtcaccgtctcctcagcctccaccaacgggcccatcggtcttccccctggccaccctcctccaacgacg

SEQ ID NO: 467 - DNA, 354 bp, Homo sapiens
caggtgcagctggtgcagtctgggtctgagatgaagaagcctggggcctcagtgaaggtgtcctgcaagacttctggatataccttcaccgactactacatacactgggtgcgacaggcccctggacaaggccttgagtggatggggtggatcaattgtaacagtgccggcacattttatgcacagaagtttcagggcagggtcatcatgacgagggacacgtccaacaacactgtctacatgcaactgaatagcctgaattcagacgacacagccgtctattattgtgcgagagtgagtcccccggacgtctggggcaaggggaccacggtcaccgtctcttcagcctccacc

SEQ ID NO: 468 - DNA, 353 bp, Homo sapiens
caggtgcagctgggacaatctggggctgaaatgaagaagcctggggcctcagtgatgctctcctgcaagacttctggatacaacttcatcgactactatatatactgggtgcgactggcccctggacgagggcttcagtggatgggatggataaaccctaacagaggtggcacaaagtatgcggagacctttcgggacaggctcaccatgaccagggacacgtccgtcagcacggcctatatggagctgaacaacctgagatctgacgacacggccgtctactactgtgcgagacttcaaagccttcatgggctttactctaacgctgactactggggccagggaacgctggt

SEQ ID NO: 469 - DNA, 369 bp, Homo sapiens
caggtgcagctggtgcagtctggggctgaggtgaagaagcctggggcctcagtgagggtcacctgcagggcttctggattcagtgtcagcgactacggtgttcattgggtgcgacaggcccctggacaaggccttgagtggatgggatggatcaatcatttcagtggtggcgccacatacgcagaggtatttcagggccgggtcgccatgaccagggacacgtccatcaacacagccttcatggaactgagaagtctgagatctgacgacacggccgtgtattactgtgcgagagataccccacgatattgtagtagtaccagctgctacatggaggtctggggcaaagggaccacggtcaccgtctcc

SEQ ID NO: 470 - DNA, 360 bp, Homo sapiens
caggtgcagctggtgcagtctggggctgagatgaagaagcctggggcctcagtgaaggtctcctgcaagacttctggatacaccttcaccgactactatatacattgggtgcggcaggcccctggacatgggcttgagtggatggcctggatcaaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctca

SEQ ID NO: 471 - DNA, 400 bp, Homo sapiens
caggtgcagctggtgcagtctggggctgaggtgaagacgcctggggcctcagtgaaagtctcctgcaggacttcaggatacaccttcaccgcttactacatacactgggtgcgacaggcccctggacacgggcttgagtgggtggggtggatcaaccccagtggaggtgccacaatctatgcacagaagtttgagggcagggtcaccttgaccagcgacacgtccattagtacagcctatttggagttgagcaacctgagacctgacgacacggccacatattattgtgtaagagatgcgactccggtgacaacggaattcgacttctggggccagggagcgctggtcaccgtctcctcacgcctccaccacggcccatccggtccttcccccgtcggcc

SEQ ID NO: 472 - DNA, 372 bp, Homo sapiens
caggtgcagctggtgcagtctggggctgaggtgaagaagcctggggcctcagtaagggtctcctgcaaggcttctggatcctccctacacgcctattatatacactgggtgcggcaggcccctggacagcggcctgagtggatggggtggctcaaccctaacagtggtggcacaaactatgcaccaaagtttcaggacagggtcaccttgaccagggagacgtccatcggcacaacccacctggggctgcgcggactggggtctgacgacacggccgtctattactgtgcgaccgaccggctaggcccccaaggctatattaactactactttgaatcctggggccagggagccctgatcaccgtctcctca

SEQ ID NO: 473 - DNA, 361 bp, Homo sapiens
caggtgcagctggtgcaagtctgggttgaggtgaagaagccctgggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaaacccgcgacacggccgtttattattgtgcgcgagacccccaagacggcactacttggtacacgcactggggccagggaacactggtcaccgtctcctcag

SEQ ID NO: 474 - DNA, 366 bp, Homo sapiens
caggtgcagctggtgcagtctgggactgaagtgaagaagcctggggcctcactgaaggtctcctgtaaggcctccggatacaccttcatcgattactatattcactgggtgcgacaagtccctggacaacggcttgagtggatgggttggatcaaccctaagactactggcgcactctatgcagacaactttcagggtagggtcaccatgaccagtgacacgtccatcaacacagtctacatggaggtgaccaggctgacatctgacgacacggccctttactactgtgcgagagaggggcattgtggtagtaccaattgtttctttgacttctggggccagggaaccctggtcaccgtctcctca

SEQ ID NO: 475 - DNA, 366 bp, Homo sapiens
caggtgcagctgggacaatctggggctgaaatgaagaagcctggggcctcagtgatgctctcctgcaagacttctggatacaacttcatcgactactatatatactgggtgcgactggcccctggacgagggcttcagtggatgggatggataaaccctaacagaggtggcacaaagtatgcggagacctttcgggacaggctcaccatgaccagggacacgtccgtcagcacggcctatatggagctgaacaacctgagatctgacgacacggccgtctactactgtgcgagacttcaaagccttcatgggctttactctaacgctgactactggggccagggaacgctggtcaccgtctcctca

SEQ ID NO: 476 - DNA, 443 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgacaagggacacgtccaccaatacagcctacatggaactgagtggactgacatttgacgacacggccatgtattattgcctcactgcaatagatgggatcgtctactggggccagggacccctggtcaccgtttcctcagcctccaccaagggcccatcggtcttccccctggcaccctcctccaagagcacctctgggggcacagcagccctggctgcctggtcaaggactac

SEQ ID NO: 477 - DNA, 381 bp, Homo sapiens
caggtgcagctggtgcagtctggggctgaggtgaagaagcctggggcctcagtaagggtctcctgcaaggcttctggatcctccctacacgcctattatatacactgggtgcggcaggcccctggacagcggcctgagtggatggggtggctcaaccctaacagtggtggcacaaactatgcaccaaagtttcaggacagggtcaccttgaccagggagacgtccatcggcacaacccacctgggggtgcgcggactggggtctgacgacacggccgtctattactgtgcgaccgaccggctaggcccccaaggctatattaactactactttgaatcctggggccagggagccctgatcaccgtctcctcagcctccacc

SEQ ID NO: 478 - DNA, 345 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtcaccgttcct

SEQ ID NO: 479 - DNA, 339 bp, Homo sapiens
caggtgcagctggtgcagtctggggctgacgtgaaggagtctggggcctcattgaaagtctcctgcaaggcttctggacacaccttcgccgcctattatgtacattgggtgcgacaggcccctggacaagggcttgagtggatgggatggatccagcctaatagcggagtcacaaagaatgcacagacctttaggggcaggctcaccatgaccagggacacgtccatcaacacagtttacatggaactgagcagactgagattcgacgacacggccctatattactgtacggagagactcagggaatggggccagggatcgctggtcaccgtctcctca

SEQ ID NO: 480 - DNA, 418 bp, Homo sapiens
caggtgcagctggtgcagtctgggcctgaagtgaagaagcctggggcctcactgaaggtctcctgtaaggcctccggatacaccttcatcgattattatattcactgggtgcgacaagtccctggacaacggcttgagtggatgggttggatcaaccctaagacaactggcgcactctatgcagacaactttcagggtagggtcaccatgaccagtgacacgtccatcaacacagtctacatggaggtgaccaggctgacatctgacgacacggccgtttactactgtgcgagagagggacattgcagtagtaccaattgtttctttgactcttggggccagggaaccctggtcaccgtctcctcagggagtgcatccgccccaacccttttccccctcgtctcctctgagaattccc

SEQ ID NO: 481 - DNA, 347 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtccaccgtttcct

SEQ ID NO: 482 - DNA, 383 bp, Homo sapiens
caggtgcagctggtgcagtctgggtctgagatgaagaagcctggggcctcagtgaaggtgtcctgcaagacttctggatataccttcaccgactactacatacactgggtgcgacaggcccctggacaaggccttgagtggatggggtggatcaattgtaacagtgccggcacattttatgcacagaagtttcagggcagggtcatcatgacgagggacacgtccaaacaacactgtctacatgcaactgaatagcctgaattcagacgacacggccgtctattattgtgcgagagtgagtcccccggagtctggggcaaggggaccacggtcaccgtctcttcagcctccaccaagggcccatccggtcttccccctggcca

SEQ ID NO: 483 - DNA, 327 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccaggga

SEQ ID NO: 484 - DNA, 368 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtcaccgtttcctcacgcctccaccaacggaccca

SEQ ID NO: 485 - DNA, 363 bp, Homo sapiens
caggtgcagctggtgcagtctggggctgaggtgaggaagcctggggcctcagtgaaggtctcctgcacggcttctggatacaccttcaccggccactatatcctctgggtgcgacaggcccgtggacaaggacttgagtgggtgggatggatcaatggtgacagaggcgacacaaagtactcacacaaatttcagggcagggtcgtcatgaccagggacaggtccaccagcacagtctccatggagttgagtagattgacatctgacgacacggccatatattattgtgcgagagatttggtccgagatggttatgatgctttagatatctggggccgagggacactggtcaccgtctcttca

SEQ ID NO: 486 - DNA, 429 bp, Homo sapiens
caggtgcagctggtgcagtctgggactgaagtgaagaagcctggggcctcactgaaggtctcctgtaaggcctccggatacaccttcatcgattactatattcactgggtgcgacaagtccctggacaacggcttgagtggatgggttggatcaaccctaagactactggcgcactctatgcagacaactttcagggtagggtcaccatgaccagtgacacgtccatcaacacagtctacatggagctgaccaggctgacatctgacgacacggccctttactactgtgcgagagaggggcattgtggtagtaccaattgtctctttgacttctggggccagggaaccctggtcaccgtctcctcagcctccaccaaggcccatcggtcttcccctgcaccctgctccaggagcacctccgagacgcac

SEQ ID NO: 487 - DNA, 375 bp, Homo sapiens
caggtgcagctggtgcagtctgggactgaagtgaagaagcctggggcctcactgaaggtctcctgtaaggcctccggatacaccttcatcgattactatattcactgggtgcgacaagtccctggacaacggcttgagtggatgggttggatcaaccctaagactactggcgcactctatgcagacaactttcagggtagggtcaccatgaccagtgacacgtccatcaacacagtctacatggaggtgaccaggctgacatctgacgacacggccctttactactgtgcgagagaggggcattgtggtagtaccaattgtttctttgacttctggggccagggaaccctggtcaccgtctcctcagcctccacc

SEQ ID NO: 488 - DNA, 327 bp, Homo sapiens; identical to SEQ ID NO: 483

SEQ ID NO: 489 - DNA, 419 bp, Homo sapiens
caggtgcagctggtgcaatctggggctgaagtgaaggagtctggggcctcagtgaaggtctcctgcgaggcttctacatataccttcatcggctactatttacactgggtacgacaggcccctggacaaggacttgagtggatgggatggatcaatcctgacaatggtgccacaaattatgcacagaaatttcagggcagggtcaccatgactagagtcacgtccatcaatacagcctacatggacctcaataatctgacatctgacgacacggccgtctatttttgtgcgagagccgaggggatttggttaggggagcccgcgccttttgatctctggggccaagggacaatggtcatcgtctctttagggagtgcatccgccccaacccttttcccctcgtctcctctgagaattcc

SEQ ID NO: 490 - DNA, 367 bp, Homo sapiens
caggtgcagctggtgcagtctggggctgaaatgaagaaacctggggcctcagtgaaggtctcctgcaaggcctctggatacacattcaccgccttctatatacactggctgcgccaggcccctgggcaggggcctgaatggatgggctggatcaaccctatcaatggagccacaatttacgcagagacctttgagggcagggtcaccctgaccagggacacgtccaccaacacagcctacatggagctgagcagcctaaaatcttacgacacggccgtttattattgtgcgagagacgcgcctccgattactacggaatttgaccagtggggccagggaaccctggttacgcgtctcctcagcctcc

SEQ ID NO: 491 - DNA, 358 bp, Homo sapiens
caggtgcagctggtgcaatctggagctgaggtaaagaagcctggggcctcagtgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtccaccgtttcctcgacgggacca

SEQ ID NO: 492 - DNA, 380 bp, Homo sapiens
caggtgcagctggtgcagtctggggctgagatgatgaagcctggggccacactgaaggtctcctgcaagacttctggatacaccttcaccaaattttatatacactgggtgcggcaggcccctggacaaggccttgagtggatgggatggatcaaccctaccagtggtaatacaaagtccgcgcagaaatttcagggccgggtcaccatgaccagtgacacgtccatcaacacagcctacacggagctgagtaaactgagatctgacgacgcggccatatattactgtgcgaaacttgccgattactataattcggagaatggtgctttagaaatctggggccaagggacaatggtcaccgtctcttcagcctccaccaa

SEQ ID NO: 493 - DNA, 355 bp, Homo sapiens
caggtgcagctggtgcagtctggggctgaaatgaagaaacctggggcctcagtgaaggtctcctgcaaggcctctggatacacattcaccgccttctatatacactggctgcgccaggcccctgggcaggggcctgaatggatgggctggatcaaccctatcaatggagccacaatttacgcagagacctttgagggcagggtcaccctgaccagggacacgtccaccaacacagcctacatggagctgagcagcctaaaatcttacgacacggccgtttattattgtgcgagagacgcgcctccgattactacggaatttgaccagtggggccagggaaccctggttagcgtct

SEQ ID NO: 494 - DNA, 345 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggaaccctggtcaccgtctcc

SEQ ID NO: 495 - DNA, 346 bp, Homo sapiens
caggtgcagctggtgcagtctggggctgaactgaggaagtctggggcctcagcgaaggtctcctgcacggccactggatacaccttcaccgcctattatgtacactgggtgcgacaggcccctggacaaggtcttgagtggatgggatgtatcaatcctcagagtgatgacacaaaatatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggtccaccgtttcc

SEQ ID NO: 496 - DNA, 384 bp, Homo sapiens
caggtgcagctggtgcagtcaggggctgaggtgaggccgcctggggcctcagtgaaggtctcctgtaaggcgtctggatacactttcaccgcctacgatatgcactgggtgcgacaggcctctggacaagggcttgagtggatgggtagggtcaaccctaacaacggggccacaaaggttgcagagaagtttcggggcagggtctccatgaccacggacacgtccatcaccacagcctacatggatatacacggactgacatctgacgacacggccgtctattactgtgcgagagatcggggggatcacgtctactattacgcgatggacacctggggccgagggaccacggtctccgtctcctcagcctccaccaagggccca

SEQ ID NO: 497 - DNA, 363 bp, Homo sapiens
caggtgcagctggtgcagtctggggctgaggtgaggaagcctggggcctcagtgaaggtctcctgcacggcttctggatacaccttcaccggccactatatcctctgggtgcgacaggccccgggacaaggacttgagtgggtgggatggatcaatggtgacagaggcgacacaaagtactcacacaaatttcagggcagggtcgtcatgaccagggacaggtccaccagcacagtctccatggagttgagtagattgacatctgacgacacggccatatattattgtgcgagagatttggtccgagatggttatgatgctttagatatctggggccgagggacactggtcaccgtctcttca

SEQ ID NO: 498 - DNA, 378 bp, Homo sapiens
caggtgcagctggtgcagtctggggctgagatgatgaagcctggggccacactgaaggtctcctgcaagacttctggatacaccttcaccaaattttatatacactgggtgcggcaggcccctggacaaggccttgagtggatgggatggatcaaccctaccagtggtaatacaaagtccgcgcagaaatttcagggccgggtcaccatgaccagtgacacgtccatcaacacagcctacatggagctgagtaaactgagatctgacgacgcggccatatattactgtgcgaaacttgccgattactataattcggagaatggtgctttagaaatctggggccaagggacaatggtcaccgtctcttcagcctccacc

SEQ ID NO: 499 - DNA, 385 bp, Homo sapiens
caggtgcagctggtgcagtcaggggctgaggtgaggccgcctggggcctcagtgaaggtctcctgtaaggcgtctggatacactttcaccgcctacgatatgcactgggtgcgacaggcccctggacaagggcttgagtggatgggtagggtcaaccctaacaacggggccacaaaggttgcagagaagtttcggggcagggtctccatgaccacggacacgtccatcaccacagcctacatggatatacacggactgacatctgacgacacggccgtctatttctgtgcgagagatcggggggatcacttctactattacgcgatggacacctggggccgagggaccacggtctccgtctcctcagcctccaccaacgggccca

SEQ ID NO: 500 - DNA, 366 bp, Homo sapiens; identical to SEQ ID NO: 474

SEQ ID NO: 501 - DNA, 438 bp, Homo sapiens
caggtgcagctggtgcagtctggggctgacgtgaaggagcctggggcctcattgaaagtctcctgcaaggcttctggacacaccttcgccgcctattatgtacattgggtgcgacaggcccctggacaagggcttgagtggatgggatggatccagcctaatagcggagtcacaaagaatgcacagacctttaggggcaggctcaccatgaccagggacacgtccatcaacacagtttacatggaactgagcagactgagattcgacgacacggccctatattactgtacggagagactcagggaatggggccagggatcgctggtcaccgtctcctcagcctccaccaagggcccatccggtcttccccctggccgccctgctccaggacgcacctccgagagcacagcggccctgggctgcctggtcaaggactac

SEQ ID NO: 502 - DNA, 367 bp, Homo sapiens
caggtgcagctggtgcagtctggggcagaggtgaagaagcctggggcctcagtgaaggtctcctgcggggcttctggatacaccttcagcaactactatatacattggctgcggcaggcccctggacaagggcttgagtggatggcctggatcaaccctagcggtggtgccacaatctatgcagagaattttcagggcagggtcaccgtaacccgggacacgtccatggaaacagtctacatggaattgaacagcctgacatctggcgacacggccgtgtattattgtgccagagatgcgactccgataactacggaatttgacttctggggccagggaacgctgatcaccgtctcctcacgcctcc

SEQ ID NO: 503 - DNA, 357 bp, Homo sapiens
caggtgcagctggtgcagtctggggctgacgtgaagaagcctggggcctcagtgaaggtctcctgcaaggcctctggatataacttcatcacttactatatacacttggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctattttgtctcactgcattagatggtgtcgcgtacgtggggccagggaacgctggtcaccgtctccgtcacgcctcca

SEQ ID NO: 504 - DNA, 494 bp, Homo sapiens
caggtgcagctggtgcagtcaggggctgaggtgaggccgcctggggcctcagtgaaggtctcctgtaaggcgtctggatacactttcaccgcctacgatatgcactgggtgcgacaggcccctggacaagggcttgagtggatgggtagggtcaaccctaacaacggggccacaaaggttgcagagaagtttcggggcagggtctccatgaccacggacacgtccatcaccacagcctacatggatatacacggactgacatctgacgacacggccgtctatttctgtgcgagagatcggggggatcacttctactattacgcgatggacacctggggccgagggaccacggtctccgtctcctcagcctccaccaagggcccatcggtcttccccctggcaccctcctccaagagcacctctgggggcacagcagccctgggctgcctggtcaaggactacttccccgaaccggtgacggtgtcgtggaactc

SEQ ID NO: 505 - DNA, 360 bp, Homo sapiens
caggtgcagctggtgcagtctggggcagaggtgaagaagcctggggcctcagtgaaggtctcctgcggggcttctggatacaccttcagcaactactatatacattggctgcggcaggcccctggacaagggcttgagtggatggcctggatcaaccctagcggtggtgccacaatctatgcagagaattttcagggcagggtcaccgtaacccgggacacgtccatggaaacagtctacatggaattgaacagcctgacatctggcgacacggccgtgtattattgtgccagagatgcgactccgataactacggaatttgacttctggggccagggaacgctgatcaccgtctcctca

SEQ ID NO: 506 - DNA, 416 bp, Homo sapiens
caggtgcagctggtgcagtcaggggctgaggtgaggccgcctggggcctcagtgaaggtctcctgtaaggcgtctggatacactttcaccgcctacgatatgcactgggtgcgacaggcccctggacaagggcttgagtggatgggtaggatcaaccctaacaacggggccacaaaggttgcagagaagtttcggggcagggtctccatgaccacggacacgtccatcaccacagcctacatggatatacacggactgacatctgacgacacggccgtctatttctgtgcgagagatcggggggatcacttctactattacgcgatggacacctggggccgagggaccacggtctccgtctcctcagcctccaccaaggcccatcggtcttcccctcggccaccctcctccaacga

SEQ ID NO: 507 - DNA, 442 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcagcctccaccaagggcccatcggtcttcccctggcaccctcctccaagacgcacctctggggcacagcagccctggctgcctggtcaaggactac

SEQ ID NO: 508 - DNA, 386 bp, Homo sapiens
caggtgcagctggtgcagtcaggggctgaggtgaggccgcctggggcctcagtgaaggtctcctgtaaggcgtctggatacactttcaccgcctacgatatgcactgggtgcgacaggcccctggacaagggcttgagtggatgggtagggtcaaccctaacaacggggccacaaaggttgcagagaagtttcggggcagggtctccatgaccacggacacgtccatcaccacagcctacatggatatacacggactgacatctgacgacacggccgtctatttctgtgcgagagatcggggggatcacttctactattacgcgatggacacctggggccgagggaccacggtctccgtctcctcacgcctccaccaacgggccca

SEQ ID NO: 509 - DNA, 359 bp, Homo sapiens
caggtgcagctggtgcagtctggggctgacgtgaaggagcctggggcctcattgaaagtctcctgcaaggcttctggacacaccttcgccgcctattatgtacattgggtgcgacaggcccctggacaagggcttgagtggatgggatggatccagcctaatagcggagtcacaaaggatgcacagacctttaggggcaggctcaccatgaccagggacacgtccatcaacacagtttacatggaactgagcagactgagattcgacgacacggccctatattactgtacggagagactcagggaatggggccagggatcgctggtcaccgtctcctcacgcctccaccaacgggccca

SEQ ID NO: 510 - DNA, 366 bp, Homo sapiens
caggtgcagctggtgcagtctgggactgaagtgaagaagcctggggcctcactgaaggtctcctgtaaggcctccggatacaccttcatcgattactatattcactgggtgcgacaagtccctggacaacggcttgagtggatgggttggatcaaccctaagactactggcgcactctatgcagacaactttcagggtagggtcaccatgaccagtgacacgtccatcaacacagtctacatggaggtgaccaggctgacatctgacgacacggccctttactactgtgcgagagaggggcattgtggtagtaccaattgtctctttgacttctggggccagggaaccctggtcaccgtctcctca

SEQ ID NO: 511 - DNA, 357 bp, Homo sapiens
caggtgcagctggtgcagtctggggctgaggtgaagaagcctggggcctcagtgaaggtctcctgcaaggcttctggatacatcttcgccggctactatatggagtgggtgcggcagacccctggacaagggcttgagtggatgggatggatcgaccctagcggtggtgccacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcc

SEQ ID NO: 512 - DNA, 358 bp, Homo sapiens
caggtgcagctggtgcagtctggggctgacgtgaaggagcctggggcctcattgaaagtctcctgcaaggcttctggacacaccttcgccgcctattatgtacattgggtgcgacaggcccctggacaagggcttgagtggatgggatggatccagcctaatagcggagtcacaaagaatgcacagacctttaggggcaggctcaccatgaccagggacacgtccatcaacacagtttacatggaactgagcagactgagattcgacgacacggccctatattactgtacggagagactcagggaatggggccagggatcgctggtcaccgtctcctcagcctccaccaacgggccca

SEQ ID NO: 513 - DNA, 438 bp, Homo sapiens
caggtgcagctggtgcagtctgggtctgaggtgaggaagcctggggcctcagtgaaggtgtcctgcaagacttctggatataccttcatcgactactacatacactgggtgcgacaggcccctggacaagggcttcagtggatgggatgggtcaattgtaacagtggcgacaccttttacggacagaggtttcagggcagagtcaccatgaccagggacacgtccaacaacacagtctacatggaaactgagcaggctgaattcagacgacacggccgtgtattattgtgggagagtgagtcccccggagtctggggcaaagggaccacggtcatcgtctcttcagcctccaccaagggcccatcggtcttccccctggccaccctcctccaagacgcacctcgtcggggcacgagcggccctgggctgcctggtcaa

SEQ ID NO: 514 - DNA, 378 bp, Homo sapiens
caggtgcagctggtgcagtctgggcctgaggtgaagaagcctggggcctcagtgaaggtctcctgtaaggcctctggatacactcgcaacacctactatgtgcactgggtgcgacaggcccctggacaaggtcttgagtggatgggatggatcaaccctaacagtggtggcacaaattatgcacagaaattccagggcagactcacgatcaccacggacgaactgaggactacagcctacatggagctgagcagcctgaaatctgaggacacggccgtctattactgtgcgagaaataccgactcagtggctacctccttgtacagtttgggcgtctggggccaagggaccgtggtcaccgtctcctcagcctccacc

SEQ ID NO: 515 - DNA, 495 bp, Homo sapiens
caggtgcagctggtgcagtctgggactgaagtgaagaagcctggggcctcactgaaggtctcctgtaaggcctccggatacaccttcatcgattactatattcactgggtgcgacaagtccctggacaacggcttgagtggatgggttggatcaaccctaagactactggcgcactctatgcagacaactttcagggtagggtcaccatgaccagtgacacgtccatcaacacagtctacatggaggtgaccaggctgacatctgacgacacggccctttactactgtgcgagagaggggcattgtggtagtaccaattgtttctttgacttctggggccagggaaccctggtcaccgtctcctcagcctccaccaagggcccatcggtcttccccctcggcaccctcctccaagacgcacctctggggcacagcggccctgggctgcctggtcaaggactacttccccgaaccggtgacggtgtcgtggaactc

SEQ ID NO: 516 - DNA, 357 bp, Homo sapiens
caggtgcagctggtgcagtctggggctgaggtgaagaagtctggggcctcagtgaaggtctcctgcaagacttctggatacaccttcaccagttatgatatcaattgggtgcgacaggtcactggacaagggcttgagtggatgggatggatgaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcagcctccacc

SEQ ID NO: 517 - DNA, 367 bp, Homo sapiens
caggtgcagctggtgcagtctggggctgacgtgaagaagcctggggcctcagtgaaggtctcctgcaggcctctggatataacttcatcacttactatatacattgggtgcgacaggccccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcagcctccaccaacgggccca

SEQ ID NO: 518 - DNA, 368 bp, Homo sapiens
caggtgcagctggtgcagtctgggactgacgtgcggaagcctggggcctcagtgaaggtctcctgcaaggcttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattattgtgcgagagagggactttgtagaactaccagctgccaatttgactactggggccagggaacgctggtcaccgtcttctcacg

SEQ ID NO: 519 - DNA, 350 bp, Homo sapiens
caggtgcagctggtgcagtctggggctgacgtgaagaagcctggggcctcagtgaaggtctcctgcaaggcctctggatataacttcatcacttactatatacattgggtgcgacgggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacg

SEQ ID NO: 520 - DNA, 366 bp, Homo sapiens
caggtgcagctggtgcagtttggggctgacatgaagaagcctgggtcctcggtgaaagtcacctgcaaggcctctggagacggcttcaccagctatgcggtcagctgggtgcgacaggcccctggacaagggcttgagtggatgggatggatcaaccctaacagaggtggcacaaagtatgcacagaagtttcagggcagggtcaccatgaccagggacacggccgtcaacacggcctatatggagctgaacagcctgagatctgacgacacggccgtctactactgtgcgagactacaaagccttagtgggttttactccaacgctgactactggggccagggaacgctggtcaccgtctcctca

SEQ ID NO: 521 - DNA, 366 bp, Homo sapiens
caggtgcagctggaacaatctggggctgaagtgaagaagcctggggcctcagtgatgctctcctgcaagacttctggatacaccttcatcgactactatatatactgggtgcgactggcccctggacgagggcttcagtggatgggatggatgaaccctaacagaggtggcacaaagtatgcagagacctttcgggacagggtcaccatgaccagggacacgtccgtcagcacggcctatatggagctaaacaacctgagatctgacgacacggccgtctactactgtgcgagacttcaaagccttcatgggctttactctaacgctgactactggggccagggaacgctggtcaccgtctcctca

SEQ ID NO: 522 - DNA, 405 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccaaggacacgtccatcagcacagcctacatggaactgagaagactgatatctgacgacacggctatctatttttgtctcactgcattagatggtgtcgcgtactggggccagggaacgctggtcaccgtctcctcagcctccaccaacgggcccactcggtcttccccctcggccaccctccctccaacgacg

SEQ ID NO: 523 - DNA, 348 bp, Homo sapiens
caggtgcagctggtgcagtctggggctgacgtgaagaagcctggggcctcagtgaaggtctcctgcaaggcctctggatataacttcatcacttactatatacattgggtgcgacgggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctca

SEQ ID NO: 524 - DNA, 366 bp, Homo sapiens
caggtgcagctggtgcagtctgggactgacgtgcggaagcctggggcctcagtgagggtctcctgcaaggcttctggatacaccttcaccgactactatatacactgggtgcgacaggcccctggacaacgtcttgagtggatgggatggttcaatcctaacactggtggcgcacactatggactggactatcagggcagagtcacgatgaccggggacacgtccatcaccacagtctacatggagttgaccagactggcatccgacgacacggccatttattattgtgcgagagagggactttgtggaactaccagctgccaatttgacttctggggccagggaacgctggtcaccgtcttctca

SEQ ID NO: 525 - DNA, 376 bp, Homo sapiens
caggtgcagctggtgcagtctggggctgaggtgaagaagcctggggcctcagtgaaggtctcctgcagggcttctggatacaggttcaccggctactatgtccattgggtgcgacaggcccctggagaaggacttgagtggatgggatagatcaatcctaatgatggaaacacagtctattcacagaagtatcagggcagggtctccatgacctgggacatgtccatctacacagcctatatggagatgagtaggctgacatctgacgacacggccgtgtattactgtgcgagcccctctcctgcgttgggctacttctcttactacatggacgtctggggcaagggaccacggtcatcgtcctcctcacgcctcc

SEQ ID NO: 526 - DNA, 348 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctca

SEQ ID NO: 527 - DNA, 358 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacgcctccacc

SEQ ID NO: 528 - DNA, 348 bp, Homo sapiens; identical to SEQ ID NO: 526

SEQ ID NO: 529 - DNA, 366 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacgcctccaccaacggccc

SEQ ID NO: 530 - DNA, 367 bp, Homo sapiens
caggtgcagctggtgcagtctgggactgacgtgcggaagcctggggcctcagtgaaggtctcctgcaaggcttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattattgtgcgagagaggactttgtagaactaccagctgccaatttgactacgtggggccagggaacgcgtggtcaccgtcttctca

SEQ ID NO: 531 - DNA, 349 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgcgtggtcaccgtctcctca

SEQ ID NO: 532 - DNA, 366 bp, Homo sapiens
caggtgcagctggtgcagtctggggctgagttgaagaagcctggggcctcagtgaaagtctcctgcaaggcttctggatacaccttcaccgccttctatatccactgggtgcgacaggcccctggacaagggcttgaatggatgggttggatcagccctgacagtggcaatacaaagtatgtggagaggttccagggcggggtcaccatgaccagggacacatccaccaacacagcctacatggagttgagcaggctgggacctgacgacacggccgtctattactgtatgaggataaatcgtggggcctactactttgaatactggggccagggaaccctggtcaccgtctcctcagcctccacc

SEQ ID NO: 533 - DNA, 348 bp, Homo sapiens
caggtgcagctggtgcagtctggggctgacgtgaagaagcctggggcctcagtgagggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttctgtctcactgcattagatggtgtcgcgtactggggccagggaacgctggtcaccgtctcctca

SEQ ID NO: 534 - DNA, 331 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgc

SEQ ID NO: 535 - DNA, 360 bp, Homo sapiens
caggtgcagctggtgcagtctggggctgaggtgaagaagcctggggcctcagtgaaagtctcctgcaaggcttctggatatatcttcagcggccactacatgaactgggtgcgacaagcccctggacaaggtcttgagtggatgggatggatcaaccctgccagtggtggcacaagatatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacgcctccaccaa

SEQ ID NO: 536 - DNA, 363 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacgcctccaccaacgg

SEQ ID NO: 537 - DNA, 358 bp, Homo sapiens; identical to SEQ ID NO: 527

SEQ ID NO: 538 - DNA, 348 bp, Homo sapiens; identical to SEQ ID NO: 533

SEQ ID NO: 539 - DNA, 376 bp, Homo sapiens
caggtgcagctggtgcagtctgggactgacgtgcggaagcctggggcctcagtgaaggtctcctgcaaggcttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattattgtgcgagagagggactttgtagaactaccagctgccaatttgactactggggccagggaacgctggtcaccgtcttctcagcctccacca

SEQ ID NO: 540 - DNA, 358 bp, Homo sapiens
caggtgcagctggtgcagtctgggaccgaggtgaagaagcctggggcctcagtgatggtcacctgcaaggcttctggatactccttcaacgactattatgtaaactgggtgcgacaggcccctggacaagggcttgagtggatgggatggatcaaccctaaaactggtgacacaaactatgcacggaagtttcagggcagggtcagtatgaccagggacacattcatcaacacagcctacatagacctgaacaaattgaaatctgacgacacggccgtttactactgtgcgatcggcagtggccaaccgtggctcttgatgtcgtggggccgagggacagttggtcaccgtctcttca

SEQ ID NO: 541 - DNA, 368 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacgcctccaccaacgggccca

SEQ ID NO: 542 - DNA, 404 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcagcctccaccaagggcccatcggtcttccccctggccaccctcctccaacgacgcca

SEQ ID NO: 543 - DNA, 348 bp, Homo sapiens; identical to SEQ ID NO: 526

SEQ ID NO: 544 - DNA, 351 bp, Homo sapiens
caggtgcagctggtgcagtctggggctgacgtgaagaagcctggggcctcagtgagggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttctgtctcactgcattagatggtgtcgcgtactggggccagggaacgcgtggtcaccgtctcctcacg

SEQ ID NO: 545 - DNA, 366 bp, Homo sapiens
caggtgcagctggtgcagtctgggactgacgtgcggaagcctggggcctcagtgaaggtctcctgcaaggcttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattattgtgcgagagagggactttgtagaactaccagctgccaatttgactactggggccagggaacgctggtcaccgtcttctca

SEQ ID NO: 546 - DNA, 393 bp, Homo sapiens
caggtgcagctggtgcagtctgggaccgaggtgaagaagcctggggcctcagtgatggtcacctgcaaggcttctggatactccttcaacgactattatgtaaactgggtgcgacaggcccctggacaagggcttgagtggatgggatggatcaaccctaaaactggtgacacaaactatgcacggaagtttcagggcagggtcagtatgaccagggacacattcatcaacacagcctacatagacctgaacaaattgaaatctgacgacacggccgtttactactgtgcgatcggcagtggccaaccgtgggctcttgatgtctggggccgagggacattggtcaccgtctcttcagcctccaccaggccatcggtctcccctgcgcctgct

SEQ ID NO: 547 - DNA, 366 bp, Homo sapiens
caggtgcagctggtgcagtctgggactgacgtgcggaagcctggggcctcagtgaaggtctcctgcaaggcttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattattgtgcgagagagggactttgagaactaccagctgccaatttgactacgtggggccagggaacgctggtcaccgtcttctca

SEQ ID NO: 548 - DNA, 358 bp, Homo sapiens; identical to SEQ ID NO: 527

SEQ ID NO: 549 - DNA, 376 bp, Homo sapiens
caggtgcagctggtgcagtctgggactgacgtgcggaagcctggggcctcagtgaaggtctcctgcaaggcttctggatacaccttcaccgactactatatacactgggtgcgacaggcccctggacaacgtcttgagtggatgggatggttcaatcctaacactggtggcgcacactatggactggactatcagggcagagtcacgatgaccggggacacgtccatcaccacagtctacatggagttgaccagactggcatccgacgacacggccatttattattgtgcgagagagggactttgagaactaccagctgccaatttgacttcgtggggccagggaacgcgtggtcaccgtcttctcagcctccacc

SEQ ID NO: 550 - DNA, 343 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtct

SEQ ID NO: 551 - DNA, 349 bp, Homo sapiens; identical to SEQ ID NO: 531

SEQ ID NO: 552 - DNA, 355 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacgcctcc

SEQ ID NO: 553 - DNA, 402 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcagcctccaccaaggtccatcggtccttccccctcggccaccctcctccaacgacg

SEQ ID NO: 554 - DNA, 391 bp, Homo sapiens
caggtgcagctggtgcagtctggggctgacgtgaagaagcctggggcctcagtgagggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttctgtctcactgcattagatggtgtcgcgtactggggccagggaacgctggtcaccgtctcctcacgcctccaccaacgggcccagtccggtccttcccccgtcggcc

SEQ ID NO: 555 - DNA, 350 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacg

SEQ ID NO: 556 - DNA, 411 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctatttttgtctcactgcattagatggtgtcgcgtactggggccagggaacgctggtcaccgtctcctcacgcctccaccaacgggcccatccggtccttccccctcggccaccctcctccaacgacgccacc

SEQ ID NO: 557 - DNA, 367 bp, Homo sapiens
caggtgcagctggttcagtctggggctgaagtgaagaagcctggggcctcggtgatggtctcctgcaaggcttctggatacaccttcactgactactatatttactgggtgcgacaggcccctgggcaagggcttgagtggatgggatggatcaaccctaacagaggtggcacaaagtatgcacagaagtttcaggggaggtcaccatgaccagggagacggccgtcgacacgggcctatttggaacttaacagcctgaaatctgacgacacggccgtctactactgtgccagactgcaaagccttcatgggttttactccaacgctgactactggggccagggaaccctggtccaccgtctcctca

SEQ ID NO: 558 - DNA, 440 bp, Homo sapiens
  misc_feature (420)..(420): n is a, c, g, or t
caggtgcagctggtgcagtctggggctgaggtgaagaagcctggggcctcagtgaaggtctcctgcagggcttctggatacaggttcaccggctactatgtccattgggtgcgacaggcccctggagaaggacttgagtggatgggatggatcaatcctaatgatggaaacacagtctattcacagaagtatcagggcagggtctccatgacctgggacatgtccatctacacagcctatatggagatgagtaggctgacatctgacgacacggccgtgtgttactgtgcgagagatcctagccccacgccgtattactatgatagtagtggttatcttagtggaggtatggacgtctggggccaagggaccacggtcaccgtctccgtcagggagtgcatccgcccaaccttttccccncgtctcctctgagacttccc

SEQ ID NO: 559 - DNA, 384 bp, Homo sapiens
caggtgcagctggtgcagtctgtgtctgaaattaagaaacttggggcctcagtgaaggtctcctgtaaggcttctggatatcccttcaccaactactttattcactgggtgcgacaggcccctggacaggggcttgagtggatggcgtggatcaaccctcacagtggtgagacacattatgcacagaagtttcagggcagggtcaccttgaccagggacacttccatcagcacagcctacatggacgtgagtgggctgagatctgacgacacggccctttattactgtgcgagggggtggaccatggtccaactgccaattgctacaagatattattactacatggatgtctggggcaaagggaccacggtcatcgtctcctca

SEQ ID NO: 560 - DNA, 436 bp, Homo sapiens
caggtgcagctggtgcagtctgggactgacgtgcggaagcctggggcctcagtgaaggtctcctgcaaggcttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattactgtgcgagagagggactttgtagaactaccagctgccaatttgactactggggccagggaacgctggtcaccgtcttctcacgcctccaccaacggcccatccggtcttccccctcggccaccctcctaccaacgacgcacctcgtcgggg

SEQ ID NO: 561 - DNA, 376 bp, Homo sapiens
caggtgcagctggtgcagtctgggactgacgtgcggaagcctggggcctcagtgaaggtctcctgcaaggcttctggatacaccttcaccgactactatatacactgggtgcgacaggcccctggacaacgtcttgagtggatgggatggttcaatcctaacactggtggcgcacactatggactggactatcagggcagagtcacgatgaccggggacacgtccatcaccacagtctacatggagttgaccagactggcatccgacgacacggccatttattattgtgcgagagagggactttgtagaactaccagctgccaatttgacttctggggccagggaacgctggtcaccgtcttctcacgcctccacc

SEQ ID NO: 562 - DNA, 348 bp, Homo sapiens; identical to SEQ ID NO: 526

SEQ ID NO: 563 - DNA, 365 bp, Homo sapiens
caggtgcagctggtgcagtctgggactgacgtgcggaagcctggggcctcagtgaaggtctcctgcaaggcttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattattgtgcgagagagggactttgtagaactaccagctgccaatttgactactggggccagggaacgctggtcaccgtcttctc

SEQ ID NO: 564 - DNA, 363 bp, Homo sapiens
caggtgcagctggtgcagtctgggactgacgtgcggaagcctggggcctcagtgaaggtctcctgcaaggcttctggatacaccttcaccgactactatattcactgggtgcgacaggcccctggacaacgtcttgagtggatggaatggttcaatcctaacactggtggcgcacactatggactggactatcagggcagagtcacgattaccacggacgaatccacgagcacagcctacatggagctgagcagcctgagatctgaggacacggccgtgtattactgtgcgagagtgagggggcgaaatagtggctacgaaagtatggacgtctggggccaagggaccacggtcaccgtctcc

SEQ ID NO: 565 - DNA, 366 bp, Homo sapiens
caggtgcagctggaacagtctgggcctgaagtgaagaagccgggggcctcagtgatggtctcctgcaaggcttctggatacaacttcatcgactactatatgtactgggtgcgacaggcccctggacaggggcctgagtggatgggatggatcaactctaatagaggtggcacaaagtatgctcagaagtttcagggaaggatcaccatgaccagggacacggccgtcagcacggcctatttggagctgaacaccctgagatctgacgacacggccgtctactactgtgcgagactacaaagccttcatggactgtattctaacgctgactattggggccagggaacactggtcaccgtctcctca

SEQ ID NO: 566 - DNA, 367 bp, Homo sapiens
caggtgcagctggtgcagtctggggctgaggtgaagaagcctggggcctcagtgaaggtctcctgcaagacttctggatacagtttcagcgactaccatgtgcactgggtgcgacaggccccgggacaaggtcttgactggatgggatggatcaaccagaatagtggtggcgcaacctatgcacagaagtttcagggcaggattgccatgacccgggacatgtccatcagcacagtcttcctggaactgagtagcctgagatttgacgacacggccatatactactgtgcgagagcccagaggccagtggcggacgcacttgagcttgaccattggggccagggaacgcgtggtcagcgtctcgtca

SEQ ID NO: 567 - DNA, 331 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatcttattttgtctcactgcattagatggtgtcgcgtactggggccagggaacgc

SEQ ID NO: 568 - DNA, 415 bp, Homo sapiens
caggtgcagctgctacagtctggggctgaggtgaagaagcctggggcctcagtgatggtctcctgcaaggcttctggatacacattcatcgactactacatatactgggtgaggcaggcccctggacaagggcctgagtggatggggtggatcaacactaacaggggtggcacaaagtatacacagaagtttcagggcagggtcaccctgaccagggacacggccgtcaccacggcctatctggagttgaacagcctgagatctgacgacacggccgtctattattgtgcgagactacaaagccttcatggactttattctaacgctgactactggggccagggaacgctggtcaccgtctcctcagcctccaccaacggcccatcggtcttccccctcggccaccctcctccaa

SEQ ID NO: 569 - DNA, 414 bp, Homo sapiens
caggtgcagctggttcagtctggggctgaggtgaagaagcctggggcctcagtgaaggtctcctgcaaggcctccggatacaccttcaccgccttctatctgcactgggtgcgacaggcccctggacgagggcttgagtggatggggtggatcaaccctatcaatggaggcacaatttactcagagaactttgagggcagggtcatcctgaccagggacacgtctaccagcacagcctacatggaactgagtggcctcagatctgacgactcggccgtatatttttgtgcgagagatgcgattccggtgactactgagtttgacttctggggccagggaacgctggtcagcgtctcccagcctccaccaaggcccatccggtcttcccccgtcggccaccctcctccaacgacg

SEQ ID NO: 570 - DNA, 371 bp, Homo sapiens
caggtgcagctggtgcagtctgggcctgaggtgaagaagcctggggcctcagtgaaagtctcctgcaaagcttctggatacaccttcaccgattattatatatactgggtgcgccagacccctggacaagggcttgagtggatgggatggatcaaccctaatcgagggggcacgaaatatgcgcagaagatgcagggcagggtcagcatgaccagggacacgtccatcaatacagtctacatggaactgagcgggctgacctctgacgacacggtccttttattactgtgcgagattacaaagtccttaatggttactactccaatgctgtacttttggggccagggaacgctggtcaccgtctcctcacg

SEQ ID NO: 571 - DNA, 366 bp, Homo sapiens
caggtgcagctggtgcagtctgggcctgaggtgaagaagcctggggcctcagtgaaagtctcctgcaaagcttctggatacaccttcaccgattattatatatactgggtgcgccagacccctggacaagggcttgagtggatgggatggatcaaccctaatcgagggggcacgaaatatgcgcagaagatgcagggcagggtcagcatgaccagggacacgtccatcaatacagtctacatggaactgagcgggctgacctctgacgacacggccttttattactgtgcgagattacaaagccttaatggttactactccaatgctgacttttggggccagggaacgctggtcaccgtctcctca

SEQ ID NO: 572 - DNA, 407 bp, Homo sapiens
caggtgcagctggtgcagtctggggctgaggtgaagaagcctggggcctcagtgatgctctcctgcaagacttctggatacaacttcatcgactactatatatactgggtgcgactggcccctggacgagggcttcagtggatgggatggataaaccctaacagaggtggcacaaagtatgcggagacctttcgggacaggctcaccatgaccagggacacgtccgtcagcacggcctatatggagctgaacaacctgagatctgacgacacggccgtctactactgtgcgagacttcaaagccttcatgggctttactctaacgctgactactggggccagggaacgctggtcaccgtctcctcagcctccaccaacgggcccactcggtccttccccctcggcca

SEQ ID NO: 573 - DNA, 379 bp, Homo sapiens
caggtgcagctggtgcagtctggggctgaggtgaagaagcctgggtcctcggtgaaggtctcctgcaaggcttctggatacaccttcaccgacttctatatacactgggtgcgacaggccccctggacaacgtcttgagtgggtgggatggtacaatcctaacactggtggcgcacactctggactggactttcagggcagagtcaccatgaccggggacacgtccatcagtacagtctacatggaactgcccaggctggcatctgacgacacggccatttattactgtgcgagagagggacattgtagtaccaccagctgcctattttgacttcgtggggccagggagcactggtcaccgtctcctcacgcctccacc

SEQ ID NO: 574 - DNA, 366 bp, Homo sapiens; identical to SEQ ID NO: 571

SEQ ID NO: 575 - DNA, 391 bp, Homo sapiens
caggtgcagctggtgcaatctggggctgaggtgaagaagcctggggcctcagtgaaggtctcctgcaaggcttctagatacacggtcaccggctattttatccactgggtgcgacaggcccctggacaagggctggagtggatgggttggatcaagcctaacagtgagagcacaaactatgcacagaagtttcgaggccgggtcaccatgaccggggacatgtccatcaacacagtctacatggagttgagaaggctgggatctgacgacacggccgtatattactgcgcttcatgcgaccggcgtggtgggcttgctacgatgtgcgaagggggggctactacgctatggacgtcgtggggccaagggaccacggtcatcgtctcctcag

SEQ ID NO: 576 - DNA, 364 bp, Homo sapiens
caggtgcagctggtgcagtctggggctgaggtaaagaagcctggggcctcggtgagggtctcctgcaaggcttctggatacacgttcaccgactactttgtacactgggtgcgacagacccctggacaaaattttgagtggatgggatggaccaacgtcaacactggtggcacaaagtatgcaccaaagtttcagggcagggtcaccatgaccagggacacgtccaacagcacagcctacattgaactgagcggcctgacatctgacgacacggccgtttattattgtacgagagatgagttgttccgtgttgatgatgcctttgatctgtggggccaagggacacgtggtcaccgtctcttca

SEQ ID NO: 577 - DNA, 413 bp, Homo sapiens
caggtgcagctggtgcagtctggggctgaggtaaagaagcctggggcctcggtgaaggtctcctgtaaggcttctggatacacgttcaccgactactttgtacactgggtgcgacaggcccctggacaaaattttgagtggatgggatggaccaacgtcaatactggtggcacaaagtatgcaccaaagtttcagggcagggtcaccatgaccagggacacgtccatcagtacagcctacattgaactgagcggcctgacatctgacgacacggccgtttattattgtacgagagatgagttgttccgtgttgatgatgcctttgatatgtggggccaagggacactggtgaccgtctcttcagcctccaccaagggcccatcggtccttccccctcggccaccctcctccaa

SEQ ID NO: 578 - DNA, 372 bp, Homo sapiens
caggtgcagctggtgcagtctggggctgaggtaaagaagcctggggcctcggtgaaggtctcctgcaaggcttctggatacacgttcaccgactactttgtacattgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgatacggccatttattattgtacgagagatgaattgttccgtgttgatgatgcctttgatatgtggggccaagggacactggtcaccgtctcttcagcctccacc

SEQ ID NO: 579 - DNA, 421 bp, Homo sapiens
caggtgcagctggtgcagtctgggcctgaggtgaagaagcctggggcctcagtgaaagtctcctgcaaagcttctggatacaccttcaccgattattatatatactgggtgcgccaggcccctggacaagggcttgagtggatgggatggatcaaccctaatcgagggggcacgaaatatgcgcagaagatgcagggcagggtcagcatgaccagggacacgtccatcaatacagtctacatggaactgagcgggctgacctctgacgacacggccttttattactgtgcgagattacaaagccttaatggttactactccaatgctgacttttggggccagggaacgctggtcaccgtctcctcagcctccaccaagggcccatcggtccttccccctcggccaccctcctccaacgacg

SEQ ID NO: 580 - DNA, 372 bp, Homo sapiens
caggtgcagctggtgcagtctggggctgaggtaaagaagcctggggcctcggtgaaggtctcctgtaaggcttctggatacacgttcaccgactactttgtacactgggtgcgacaggcccctggacaaaattttgagtggatgggatggaccaacgtcaatactggtggcacaaagtatgcaccaaagtttcagggcagggtcaccatgaccagggacacgtccatcagtacagcctacattgaactgagcggcctgacatctgacgacacggccgtttattattgtacgagagatgagttgttccgtgttgatgatgcctttgatatgtggggccaagggacactggtgaccgtctcttcagcctccacc

SEQ ID NO: 581 - DNA, 412 bp, Homo sapiens
caggtgcagctggtgcagtctggggctgaggtgaagaagcctggggcctcagtgaaggtctcctgcaaggcctccggatacaccttcaccgccttctatctgcactgggtgcgacaggcccctggacgagggcttgagtggatggggtggatcaaccctatcaatggaggcacaatttactcagagaactttgagggcagggtcatcctgaccagggacacgtctaccagcacagcctacatggaactgagtggcctcagatctgacgactcggccgtatatttttgtgcgagagatgcgattccggtgactactgagtttgacttctggggccagggaacgctggtcagcgtctcccagcctccaccaaggcccatcggtcttccccctcggccaccctcctccaacgacg

SEQ ID NO: 582 - DNA, 363 bp, Homo sapiens
caggtgcagctggtgcagtctggggctgaggtaaagaagcctggggcctcggtgaaggtctcctgcaaggcttctggatacacgttcaccgactactttgtacattgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgatacggccatttattattgtacgagagatgaattgttccgtgttgatgatgcctttgatatgtggggccaagggacactggtcaccgtctcttca

SEQ ID NO: 583 - DNA, 423 bp, Homo sapiens
caggtgcagctggtgcagtctggagctgaggtgaagaagcctggggcctcagtgaaggtctcctgcaaggcttctggttacacccttaccagctatggtatcagctgggtgcgacaggcccctggacaaggtcctgagtggctgggatggatcaaccctaaaagtggtgacacaaattatgcacagaagtttcagggcagagtcatgctgacaagggacacgtccatcaccacagtccacatggaggtgaacaggctcagatctgacgacacggccatgtattactgtgcgagagcgccctttgttcaggatagtggctacgattgggtgttcggccattggggccagggaacgctggtcaccgtctcctcagggagtgcatccgccccaacccttttcccctcgtctcctctgagaattccc

SEQ ID NO: 584 - DNA, 328 bp, Homo sapiens
caggtgcagctggtgcagtctggggctgacgtgaagaagcctggggcctcagtgaaggtctcctgcaaggcctctggatataacttcatcacttactatatacattgggtgcgacaggcccctggacaagggcttgagtggatgggatgtatcaaccctaatagtggtggcacaaattatgcacagaggtttcaggacaaggtctccatgaccagggacacgtccatcagcacagcctacatggaactgagaagactgatatctgacgacacggctatctattttgtctcactgcattagatggtgtcgcgtacgtggggccagggaa

SEQ ID NO: 585 - DNA, 454 bp, Homo sapiens
caggtgcagctggtgcagtctggggctgaggtaaagaagcctggggcctcggtgaaggtctcctgtaaggcttctggatacacgttcaccgactactttgtacactgggtgcgacaggcccctggacaaaattttgagtggatgggatggaccaacgtcaatactggtggcacaaagtatgcaccaaagtttcagggcagggtcaccatgaccagggacacgtccatcagtacagcctacattgaactgagcggcctgacatctgacgacacggccgtttattattgtacgagagatgagttgttccgtgttgatgatgcctttgatatgtggggccaagggacactggtgaccgtctcttcagcctccaccaaggcccatccggtcttccccctggccaccctcctccaagacgcacctcgtggggcacagcagccctgggctgcctggtcaa

SEQ ID NO: 586 - DNA, 363 bp, Homo sapiens
caggtgcagctggtgcagtctggggctgaggtaaagaagcctggggcctcggtgaaggtctcctgtaaggcttctggatacacgttcaccgactactttgtacactgggtgcgacaggcccctggacaaaattttgagtggatgggatggaccaacgtcaatactggtggcacaaagtatgcaccaaagtttcagggcagggtcaccatgaccagggacacgtccatcagtacagcctacattgaactgagcggcctgacatctgacgacacggccgtttattattgtacgagagatgagttgttccgtgttgatgatgcctttgatatgtggggccaagggacacgtggtgaccgtctcttc

SEQ ID NO: 587 - DNA, 380 bp, Homo sapiens
caggtgcagctggtgcagtctggggctgaggtgaagaagcgtggggcctcagtgaaggtctcctgtaaggcttctggaaactttttcaccggctataatatacactgggtgcgacaggcctctggacaagggctcgagtggatgggatggatcaaccctgacaatggtgccacaaaatatgcacaggggtttcagggcagggtcaccatgaccagggacacgtccatcaaaacaacctacatggaattgagtcggctgacatctgacgacacggccgtctattattgtacaagagcaattggttcggggagttattataacggggaggaaaagcattactttctctattggggccagggaacgctggtcaccgtctcctc

SEQ ID NO: 588 - DNA, 381 bp, Homo sapiens
caggtgcagctggtgcagtctggggctgaggtaaagaagcctggggcctcggtgaaggtctcctgtaaggcttctggatacacgttcaccgactactttgtacactgggtgcgacaggcccctggacaaaattttgagtggatgggatggaccaacgtcaatactggtggcacaaagtatgcaccaaagtttcagggcagggtcaccatgaccagggacacgtccatcagtacagcctacattgaactgagcggcctgacatctgacgacacggccgtttattattgtacgagagatgagttgttccgtgttgatgatgcctttgatatgtggggccaagggacactggtgaccgtctcttcagcctccaccaacggccca

SEQ ID NO: 589 - DNA, 363 bp, Homo sapiens
caggtgcagctggtgcagtttggaggtgaggtgaagaagcctgggtcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacacgtggtcaccgtctcttc

SEQ ID NO: 590 - DNA, 362 bp, Homo sapiens
caggtgcagctggtgcagtctggggctgaggtgaagaagcctggggcctcagtgaaggtctcctgcaaggcttctggatacaccttcaccgacttctatatacactgggtgcgacaggcccctggacaacgtcttgagtgggtgggatggtacaatcctaacactggtggcgcacactctggactggactttcagggcagagtcaccatgaccggggacacgtccatcagtacagtctacatggaactgcccaggctggcatctgacgacacggccatttattactgcgcgagagaacgtatggcgactggtactgcgatctcgtggggccgcggcaccctggtcactgtctcctcacgcct

SEQ ID NO: 591 - DNA, 366 bp, Homo sapiens
caggtgcagctggtgcagtccggggctgaggtgaggaagcctggggcctcagtgaagatttcctgtcagacttctggatacacgttcagcgactactttctccactgggtgcgacaggcccctggacaagggcttgagtggatggcatggatcaaccctactaatggtgacacaaactttgcacagacgtttcagggcggggtcaccgtgaccagggacacgtccattagcacagtctacatggagctcagcagtctgaagtctgacgacacggccgtgtatttctgtgcgagaggagtccggcgctatagtggcagctggtacttggggtactggggccagggaaccctggtcaccgtctcctca

SEQ ID NO: 592 - DNA, 376 bp, Homo sapiens
caggtgcagctggtgcagtctggggctgaagtaaagaaacctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgccccaaagtttcagggcagggtcatcatgaccagggacacgtccatcagcacagcctacattgaactgagcggcctgacatctgacgacacggccgtttattactgtacgagagatgagttgttccgtgttgatgatgcctttgatatgtggggccaagggacactggtcaccgtctcttcacgcctccaccaac

SEQ ID NO: 593 - DNA, 362 bp, Homo sapiens
caggtgcagctggtgcagtctggggctgaggtaaagaagcctggggcctcggtgagggtctcctgcaaggcttctggatacacgttcaccgactactttgtacattgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccatttattattgtacgagagatgaattgttccgtgttgatgatgcctttgatatgtggggccaagggcactggtcaccgtctcttca

SEQ ID NO: 594 - DNA, 365 bp, Homo sapiens
caggtgcagctggtgcagtctggggctgaggtgaagaagcctggggcctcagtgaaggtctcctgcaaggcttctggatacaccttcaccgcctactatttgaactgggtgcgacaggcccctggacaagggcttgagtgggtgggatggatcaatcctaacagtggtgtcacaatctatgcagaggcttttgagggcagggtcaccgtaaccacggacacgtccatgaaaacagtctacatggagttggagagcctgacatctggcgacacggccatgtatttctgcgccagagatgcgactccgataactacggaatttgactactggggccagggaacactgatcaccgtctcctcacgcct

SEQ ID NO: 595 - DNA, 378 bp, Homo sapiens
caggtgcagctggtgcagtctgggcctgaggtgaagaagcctggggcctcagtgaaggtctcctgtaaggcctctggatacactcgcaacacctactatgtgcactgggtgcgacaggcccctggacaaggtcttgagtggatgggatggatcaaccctaacagtggtggcacaaattatgcacacaagtttcaaagtagggtcaccatgaccagggacacgtccatctctacattctacatggagttgagcggactgacatctgacgacacggccatctattactgtgcgactgatttcgacggggggaatttcctttattactttgactcctggggtccagggaacggtgctcaccgtctcctcagcctccaccaa

SEQ ID NO: 596 - DNA, 360 bp, Homo sapiens
caggtgcagctggtgcagtctggggctgaagtgaagaagcctggggcctcagtgaaggtctcctgcaaggcttctggatacaccttcaccgactactatattcactgggtgcgacaggcccctggacaacgtcttgagtggatgggatggttcaatcctaacactggtggcgcacactatggactggactatcagggcagagtcactatgaccggggacacgtccatgaccacagtctacatggagttgaccaggctggcatccgacgacacggccatttattattgtgcgagagagggactttgtagaactaccagctgccaatttgactactggggccagggaacgctggtcaccgtc

SEQ ID NO: 597 - DNA, 366 bp, Homo sapiens
caggtgcagctggtgcagtctggggctgaggtgaagaagcctggggcctcagtgatggtctcctgcaaggcttctggatacacattcatcgactactacatatactgggtgaggcaggcccctggacaagggcctgagtggatggggtggatcaacactaacaggggtggcacaaagtatgcacagaagtttcagggcagggccaccctgaccagggacacggccgtcaccacggcctatctggagttgaacagcctgagatctgacgacacggccgtctattattgtgcgagactacaaagccttcatggactttattctaacgctgactactggggccagggaacgctggtcaccgtctcctca

SEQ ID NO: 598 - DNA, 374 bp, Homo sapiens
  misc_feature (318)..(318): n is a, c, g, or t
caggtgcagctggtgcagtctgggcctgaagtgaagaagccgggggcctcagtgatggtctcctgcaaggcttctggatacaccttcatcgactactatatttactgggtgcgacaggcccctggacaggggcttgagtggatgggatggatcaacccgaacagaggtggcacaaagtatgctcagaactttcagggaagggtcaccatgaccagggacacggccgtcagcacggcctatatggagctgaactccgtgagatctgacgacacggccgtctactacttgcgagactacaaagccttcatgggctttacnctaacgctgactacgtggggccagggaacgctcggtcaccgtctcctcacgcctcc

SEQ ID NO: 599 - DNA, 367 bp, Homo sapiens
caggtgcagctggtgcagtctggggctgaggtaaagaagcctggggcctcggtgaaggtctcctgcaaggcttctggatacacgttcaccgactactttgtacattgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccatttattattgtacgagagatgaattgttccgtgttgatgatgtcctttgatagtggtggggccaagggacacgtggtcaccgtctcttca

SEQ ID NO: 600 - DNA, 417 bp, Homo sapiens
  misc_feature (398)..(398): n is a, c, g, or t
caggtgcagctggtgcagtctgggcctgaagtgaagaagccgggggcctcagtgatggtctcctgcaaggcttctggatacaccttcatcgactactatatatactgggtgcgacaggcccctggacaggggcttgagtggatgggatggatcaacccgaacagaggtggcacaaagtatgctcagaactttcagggaaggatcaccatgaccagggacacggccgtcagcacggcctatatggagctgaactccctgagatttgacgacacggccgtctactactgtgcgagactacaaagccttcatgggctttactctaacgctgactactggggccagggaacgctggtcaccgtctcctcagggagtgcatccgccccaacccttttcccccncgtctcctctgagaattcc

SEQ ID NO: 601 - DNA, 346 bp, Homo sapiens
caggtgcagctggtgcagtctggggctgaggtaaagaagcctggggcctcggtgaaggtctcctgcaaggcttctggatacacgttcaccgactactttgtacaccgggtgcgacaggcccctggacaaaattttgagtggatgggatggaccaacgtcaacactggtggcacaaactatgcaccaaggtttcagggcagagtcaccatgaccagggacacgtccatcagcacagcctacattgaactgagcggcctgacatctgacgacacggccgtttattattgtacgagagatgagttgttccgtgttgatgatgcctttgatatgtggggccaagggacac

SEQ ID NO: 602 - DNA, 376 bp, Homo sapiens
caggtgcagctggtgcagtctgggcctgaagtgaagaagccgggggcctcagtgatggtctcctgcaaggcttctggatacaacttcatcgactactatatgtactgggtgcgacaggcccctggacaggggcctgagtggatgggatggatcaactctaatagaggtggcacaaagtatgctcagaagtttcagggaaggatcaccatgaccagggacacggccgtcagcacggcctatttggagctgaacaccctgagatctgacgacacggccgtctactactgtgcgagactacaaagccttcatggactgtattctaacgctgactattggggccagggaacgctggtcaccgtctcctcacgcctccacc

SEQ ID NO: 603 - DNA, 375 bp, Homo sapiens
caggtgcagctggtgcagtctggggctgaagtgaggaagcctggggcctcagtgaaggtttcctgtaaggcttctggatacacatttaccgactactttatacactgggtgcgacaggcccctggacaagggcttgagtggatggggaggatcaaccctaaaagtggaggcacaaattatgcacagaaatttcaaatttcggtcaccatgacctgggacacatccatcagtacagcctacatagaggtgaacaggctgacatctgacgacacggccgtgtattactgtgcgagaggggaccggctagctccctataatagccgagtgcgatatttcgatctctggggccgcggcactctggtcactgtctcctca

SEQ ID NO: 604 - DNA, 428 bp, Homo sapiens
caggtgcagctggaacagtctgggcctgaagtgaagaagccgggggcctcagtgatggtctcctgcaaggcttctggatacaacttcatcgactactatatgtactgggtgcgacaggcccctggacaggggcctgagtggatgggatggatcaactctaatagaggtggcacaaagtatgctcagaagtttcagggaaggatcaccatgaccagggacacggccgtcagcacggcctatttggagctgaacaccctgagatctgacgacacggccgtctactactgtgcgagagaatcgattgtagtggtggtagctgcttccacttactcctacggtatggacgtctggggccaagggaccacggtcaccgtctcctcagggagtgcatccgccccaacccttttccccctcgtcctcctctgacg

SEQ ID NO: 605 - DNA, 372 bp, Homo sapiens
caggtgcagctggtgcagtctggggctgaagtaaagaagcctggggcctcggtgaaggtctcctgcaaggcttctggatacacgttcaccgactactttgtacactgggtgcgacaggcccctggacaaaatcttgagtggatggggtggaccaacgtcaacactggtggcacaaattatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacactggtcaccgtctcttcagcctccacc

SEQ ID NO: 606 - DNA, 385 bp, Homo sapiens
caggtgcagctggtgcagtctggggctgaggtgaagaagcctggggcctcagtgaaggtctcctgcaaggcttctggatacagcttcagcgacttctatatacactgggtgcgacaggcccctggacaacgtcttgagtggatgggatggttcaaccctaacactggtggcgcacactctggactggactttcaggacagagtcaccatgaccggggacacgtccatcagcacagcctacatggaactgcccaggctggcatctgacgacacggccatttattactgtgcgagagagggacattgtcctaccaccagctgccattttgacttctggggccagggagcactggtcaccgtctcctcagcctccaccaacgggccca

SEQ ID NO: 607 - DNA, 365 bp, Homo sapiens
caggtgcagctggtgcagtctggggctgaggtgaagaagcctggggcctcagtgaacgtctcctgcaaggcttctgaatacactttcaccacatattacttgcattgggtgcgacaggcccctggacaaggtcttgagtgggtaggttggatcaaccctaaagatggtggcacaaagtatgcacagaaatttcagggcagggtcaccatgaccagggacacgtccatcaccacagcctacatggaattaagcagcctcaaatctgacgacacggccatgtatttctgtgccagagatctcggacatttatcatcagctggaacttatgccttctggggccagggaaccctggtcaccgtctcctc

SEQ ID NO: 608 - DNA, 381 bp, Homo sapiens
caggtgcagctggtgcagtctggggctgaggtgaagaagcgtggggcctcagtgaaggtctcctgtaaggcttctggaaactttttcaccggctataatatacactgggtgcgacaggcctctggacaagggctcgagtggatgggatggatcaaccctgacaatggtgccacaaaatatgcacaggagtttcagggcagggtcaccatgaccagggacacgtccatcaaaacaacctacatggaattgagtcggctgacatctgacgacacggccgtctattattgtacaagagcaattggttcggggagttattataacggggaggaaaagcattactttctctattggggccagggaacgctggtcaccgtctcctca

SEQ ID NO: 609 - DNA, 375 bp, Homo sapiens
caggtgcagctggtgcagtctggggctgaggtaaagaagcctggggcctcggtgagggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccaacagcacagcctacattgaactgagcggcctgacatctgacgacacggccgtttattattgtacgagagatgagttgttccgtgttgatgatgcctttgatctgtggggccaagggacactggtcaccgtctcttcagcctccaccaac

SEQ ID NO: 610 - DNA, 411 bp, Homo sapiens
caggtgcagctggtgcagtctggggctgaagtaaagaagcctggggcctcggtgaaggtctcctgcaaggcttctggatacacgttcaccgactactttgtacactgggtgcgacaggcccctggacaaaattttgagtggatggggtggaccaacgtcaacactggtggcacaaattatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacactggtcaccgtctcttcagcctccaccaacggccatcgtcttcccctcggccaccctcctccaaga

SEQ ID NO: 611 - DNA, 425 bp, Homo sapiens
caggtgcagctggtgcagtctggggctgaggtaaagaagcctggggcctcggtgaaggtctcctgcaaggcttctggatacacgttcaccgactactttgtacattgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccatttattattgtacgagagatgaattgttccgtgttgatgatgcctttgatatgtggggccaagggacactggtcaccgtctcttcagcctccaccaacgggcccactccggtcttccccctcggccgccctgcctccaacgacgcacc

SEQ ID NO: 612 - DNA, 441 bp, Homo sapiens
caggtgcagctggtgcagtctgggactgacgtgcggaagcctggggcctcagtgagggtctcctgcaaggcttctggatacaatttcaccggctactttatccactgggtgcgacagggccctggacaagggcttgagtggatgggatgggtgaacccaaacaccggtggcgcaaagtatgcacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacactggtcaccgtctcctcagcctccaccaagggcccatcggtcttcccctggcaccctcctccaagagcacctctgggggcacagcggccctgggctgcc

SEQ ID NO: 613 - DNA, 375 bp, Homo sapiens
caggtgcagctggtgcagtctggggctgaggtgaggaagcctggggcctcactgagggtctcctgcaaggcttctggatacattttcagcgactaccatctacactgggtgcgacaggccccgggacaagggcttgagtggatggggtggatcaaccataatagtggtggcgcaacctatgcacagaaatttcagggcaggattgccatgaccagggacacgtccatcgacacagccttcctggaactgagtaggctgagatttgacgacacggccgtatattactgtgcgagagcccagaggccagtggcggacgcacttgaacttgaccattggggccagggaacgctggtcagcgtctcgtcagcctccacc

SEQ ID NO: 614 - DNA, 366 bp, Homo sapiens
caggtgcagctggtgcagtctggggctgaggtaaagaagcctggggcctcggtgaaggtctcctgcaaggcttctggatacacgttcaccgactactttgtacattgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccatttattattgtacgagagatgaattgttccgtgttgatgatgcctttgatatgtggggccaagggacactggtcaccgtctcttcagcc

SEQ ID NO: 615 - DNA, 365 bp, Homo sapiens
caggtgcagctggtgcagtctggggctgaggtgaggaagcctggggcctcactgagggtctcctgcaaggcttctggatacattttcagcgactaccatctacactgggtgcgacaggccccgggacaagggcttgagtggatggggtggatcaaccataatagtggtggcgcaacctatgcacagaaatttcagggcaggatcgccatgaccagggacacgtccatcgacacagccttcctggaactgagtaggctgagatttgacgacacggccgtatattactgtgcgagagcccagaggccagtggcggacgcacttgaacttgaccattggggccagggaacgctggtcagcgtctcgtc

SEQ ID NO: 616 - DNA, 366 bp, Homo sapiens
caggtgcagctggtgcagtctgggaccgaggtgaagaagcctggggcctcagtgatggtcacctgcaaggcttctggatactccttcaacgactattatgtaaactgggtgcgacaggcccctggacaagggcttgagtggatgggatggatcaaccctaaaactggtgacacaaactatgcacggaagtttcagggcagggtcagtatgaccagggacacattcatcaccacagcctacttggaactgaacagtctgacatctgacgacacggccgtctattactgtgtgagaggtgcgcgggggatgccgaaaggtgcttttgatatctggggccaagggacactggtcattgtctcttcagcc

SEQ ID NO: 617 - DNA, 429 bp, Homo sapiens
caggtgcagctggtgcagtctgggcctgaagtgaagaagccgggggcctcagtgatggtctcctgcaaggcttctggatacaccttcatcgactactatatttactgggtgcgacaggcccctggacaggggcttgagtggatgggatggatcaacccgaacagaggtggcacaaagtatgctcagaactttcagggaagggtcaccatgaccagggacacggccgtcagcacggcctatatggagctgaactccgtgagatctgacgacacggccgtctactactgtgcgagactacaaagccttcatgggctttactctaacgctgactactggggccagggaacgctggtcaccgtctcctcacgcctccaccaacgggcccatccggtccttcccccgtcggccaccctcctcccaacgacgcca

SEQ ID NO: 618 - DNA, 363 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactgttggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacactggtcaccgtctcttca

SEQ ID NO: 619 - DNA, 379 bp, Homo sapiens
caggtgcagctggtgcagtctggggttgaggtgaagaaacctggggcctcaatgaaggtctcctgcaaggcttctggatacaatttcaccggctactttatccactgggtgcgacatggccctggacaagggcttgagtggatgggatggatgaacccaaacaccggtggcgcaaagtatggacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacactggtcaccgtctcctcagcctccaccaacgggccca

SEQ ID NO: 620 - DNA, 374 bp, Homo sapiens
caggtgcagctggtgcagtctggggctgaggtgaagaagcctggggcctcagtgaaggtctcctgcaaggcttctggatacaccttcaccgacttctatatacactgggtgcgacaggcccctggacaacgtcttgagtgggtgggatggtacaatcctaacactggtggcgcacactctggactggactttcagggcagagtcaccatgaccggggacacgtccatcagtacagtctacatggaactgcccaggctggcatctgacgacacggccatttattactgtgcgagagagggacattgtagtaccaccagctgccattttgacttctggggccagggagcactggtccaccgtctcctcacgcctcc

SEQ ID NO: 621 - DNA, 377 bp, Homo sapiens
caggtgcagctggtgcggtctggggctgagatgaagaagcctggggcctcagtgaaggtctcctgcaagacttctggatacacctttaccgactactatttccactggctgcgacaggccccctggacaagggcttgagtggatgggatggctcgtccctaacactggtggcacaaactatgcactaaattttcagggcaggtcgccatgaccagggacacgtccatcagcacagtctacatggaattgcgtcgcctcagatctgacgacacggccgtctattattgtgtgagagacggcggccggcggttgggcggcagctggtacccaaattttgacaagtggggaccagggaacacttatcaccgtctcctcag

SEQ ID NO: 622 - DNA, 377 bp, Homo sapiens
  misc_feature (348)..(348): n is a, c, g, or t
caggtgcagctggtacagtctgggcctgaggtgaagaagccgggggcctcagtgatggtctcctgcaaggcttctggatacaccttcatcgactactatatttactgggtgcgacaggcccctggacaggggcttgagtggatgggatggatcaacccgaacagaggtggcacaaagtatgctcagaactttcagggaagggtcaccatgaccagggacacggccgtcagcacggcctatatggagctgaactccgtgagatctgacgacacggccgtctactactgtgcgagactacaaagccttcatgggctttactctaacgctgactactggggccagggaacnctggcccaccgtctcctcacgcctccacc

SEQ ID NO: 623 - DNA, 475 bp, Homo sapiens
caggtgcagctggtgcagtctggggctgaggtgaggaagcctggggcctcagtgaaggtctcctgcaaggcttctggatacaccttcaccgactactacatccactgggtgcgacaggtccctggacaggggcttgagtggataggatggatccaccctaacagtggtagagcaacccatacacagaagtttcagggcagggtcaccatgaccagtggcacgtctatcagtacagtctacatggaacttactgggctgacacctgacgacacggccgtctattattgtgcgagagacaattatcggaataacgtctgggtcctctatacctttgactactggggccagggaacgctggtcaccgtctcctcagcctccaccaagggcccatcggtcttccccctggcaccctcctccaagagcacctctggggcacagcagccctgggctgcctggtcaaggactacttcccgaa

SEQ ID NO: 624 - DNA, 364 bp, Homo sapiens
caggtgcagctggtgcagtctggggctgaagtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaattatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacacgtggtcaccgtctcttca

SEQ ID NO: 625 - DNA, 366 bp, Homo sapiens
caggtgcagctggtgcagtctgggcctgaagtgaagaagccgggggcctcagtgatggtctcctgcaaggcttctggatacaccttcatcgactactatatttactgggtgcgacaggcccctggacaggggcttgagtggatgggatggatcaacccgaacagaggtggcacaaagtatgctcagaactttcagggaagggtcaccatgaccagggacacggccgtcagcacggcctatatggagctgaactccgtgagatctgacgacacggccgtctactactgtgcgagactacaaagccttcatgggctttactctaacgctgactactggggccagggaacgctggtcaccgtctcctca

SEQ ID NO: 626 - DNA, 426 bp, Homo sapiens
caggtgcagctggtgcagtctgggcctgaagtgaagaagccgggggcctcagtgatggtctcctgcaaggcttctggatacaccttcatcgactactatatatactgggtgcgactggcccctggacaggggcttgagtggatgggatggatcaaccctaatagaggtggcacaaagtatgctcagaagtttcagggaaggatcaccatgaccagggacacggccgtcagcacggcctatatggagctgaccaccctgagatctgacgacacggccatgtactattgtgcgagactacaaagccttcatgggctttactctaacgctgactactggggccagggaacgctggtcaccgtctcctcacgccccacacggccactcgtctcccctcgcaccctcctccacgacgcacctcgtcggggc

SEQ ID NO: 627 - DNA, 427 bp, Homo sapiens
caggtgcagctggtgcagtctggggctgaggtgaggaagcctggggcctcagtgaaggtctcctgcaaggcttctggatacaccttcaccgactactacatccactgggtgcgacaggtccctggacaggggcttgagtggataggatggatccaccctaacagtggtagagcaacccatacacagaagtttcagggcagggtcaccatgaccagtggcacgtctatcagtacagtctacatggaacttactgggctgacacctgacgacacggccgtctattattgtgcgagagacaattatcggaataacgtctgggtcctctatacctttgactactggggccagggaacgctggtcaccgtctcctcagcctccaccaacgggcccatccggtcttcccctcggccaccctcctccaacgacg

SEQ ID NO: 628 - DNA, 372 bp, Homo sapiens
caggtgcagctggtgcagtctggggctgaggtaaagaagcctggggcctcggtgaaggtctcctgcaaggcttctggatacacgttcaccgactactttgtacactgggtgcggcaggcccctggacaaaattttgagtggatgggatggaccaacgtcaacactggtggcacaaattatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacactggtcaccgtctcttcagcctccacc

SEQ ID NO: 629 - DNA, 372 bp, Homo sapiens
caggtgcagctggtgcagtctggggctgaggtgaggaagcctggggcctcagtgaaggtctcctgcaaggcttctggatacaccttcaccgactactacatccactgggtgcgacaggtccctggacaggggcttgagtggataggatggatccaccctaacagtggtagagcaacccatacacagaagtttcagggcagggtcaccatgaccagtggcacgtctatcagtacagtctacatggaacttactgggctgacacctgacgacacggccgtctattattgtgcgagagacaattatcggaataacgtctgggtcctctatacctttgactactggggccagggaacgctggtcaccgtctcctca

SEQ ID NO: 630 - DNA, 426 bp, Homo sapiens
caggtgcagctggtgcagtctggggctgaggtgaggaagcctggggcctcagtgaaggtctcctgcaaggcttctggatacaccttcaccgactactacatccactgggtgcgacaggtccctggacaggggcttgagtggataggatggatccaccctaacagtggtagagcaacccatacacagaagtttcagggcagggtcaccatgaccagtggcacgtctatcagtacagtctacatggaacttactgggctgacacctgacgacacggccgtctattattgtgcgagagacaattatcggaataacgtctgggtcctctatacctttgactactggggccagggaacgctggtcaccgtctcctcagcctccaccaagggcccatccggtcttccccctggccaccctcctccaacgacg

SEQ ID NO: 631 - DNA, 366 bp, Homo sapiens
caggtgcagctggtgcactctggggctgaggtgaagaagcctggggcctccgtgaaggtctcctgtcagacttctggatacacgttcagcgactactttctccactgggtgcgacaggcccctggacaaggacttgagtggatggcatggatcaaccctactaatggtgacacaaactttgcacagacgtttcagggcagggtcaccgtgaccagggacacgtccattagcacagtctacatggagctcagcagtctgaagtctgacgacacggccgtgtatttctgtgcgagaggagtccggcgctatagtggcagctggtacttggggtactggggccagggaaccctggtcaccgtctcctca

SEQ ID NO: 632 - DNA, 366 bp, Homo sapiens
caggtgcagctggtgcagtctggggcagaggtgaagaagcctggggcctcagtgaaggtctcctgcaaggcttctggatacacattcatcgactactacatatactgggtgaggcaggcccctggacaagggcctgagtggatggggtggatcaacactaacaggggtggcacaaagtatgcacagaagtttcagggcagggtcaccctgaccagggacacggccgtcaccacggcctatctggagttgaacagcctgagatctgacgacacggccgtctattattgtgcgagactacaaagccttcatggactttattctaacgctgactactggggccagggaacgctggtcaccgtctcctca

SEQ ID NO: 633 - DNA, 349 bp, Homo sapiens
caggtgcagctggtgcagtctgggcctgaagtgaagaagccgggggcctcagtgatggtctcctgcaaggcttctggatacaccttcatcgactactatatttactgggtgcgacaggcccctggacaggggcttgagtggatgggatggatcaacccgaacagaggtggcacaaagtatgctcagaactttcagggaagggtcaccatgaccagggacacggccgtcagcacggcctatatggagctgaactccgtgagatctgacgacacggccgtctactactgtgcgagactacaaagccttcatgggctttactctaacgctgactactggggccagggaacgc

SEQ ID NO: 634 - DNA, 366 bp, Homo sapiens
caggtgcagctggtgcagtctggggctgaggtgaagaagcctggggcctcagtgatggtctcctgcaaggcttctggatacacattcatcgactactacatatactgggtgaggcaggcccctggacaagggcctgagtggatggggtggatcaacactaacaggggtggcacaaagtatgcacagaagtttcagggcagggtcaccctgaccagggacacggccgtcaccacggcctatctggagttgaacagcctgagatctgacgacacggccgtctattattgtgcgagactacaaagccttcatggactttattctaacgctgactactggggccagggaacgctggtcaccgtctcctca

SEQ ID NO: 635 - DNA, 388 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggacccaacgtcaacactggtggcacaaattatgcaccaaagtttcagggcagggtcaccatgaccagggacacgtccatcagcacagcctacattgaactgagcggcctgacatctgacgacacggccgtttatattgtacgagagatgaattgttccgtgttgatgatgcctttgatatgtggggccaagggacactggtcaccgtctcttcagcctccaccaaggcccatcggtctt

SEQ ID NO: 636 - DNA, 376 bp, Homo sapiens
caggtgcagctggtgcagtctggggctgaggtgaagaagcctggggcctcagtaaaggtctcctgcaaggcttctggatacaccttcagcgcctactatctacactgggtgcgacaggcccctggacaagggcttgagtggatgggatgcatcaaccctaatagtggtgccacaatttacgcaccgaagtttcagggcagggtcaccttgaccacggacacgcccatcagcacgaccttcatggagatgagcggactgacatatggcgacacggccgtatattattgttcgagagattacgctgaaatcttgactgattattatatagtggactactggggccaggggaccctggtcaccatctcctcacgcctcc

SEQ ID NO: 637 - DNA, 376 bp, Homo sapiens
caggtgcagctggtgcagtctggggctgaggtgaagaagcctggggcctcagtgaaggtctcctgcaaggcttctggagacatcttcagcgactacggtgtacactgggtgcgacaggcccccggacaagggcttgagtggatgggatggatcaatcataatagtggtggcgcaacctatgcccagaagtttcacggcagggtcgccatgaccagggacacgtccatcagtatggccttcatggaactgagtagactgagatttgacgacacggccgtatattattgtgcgagagcccagaggcccgtggctgacgcacttgagcttgactcttggggccagggaacgctggtctccgtctcgtcacgcctccacc

SEQ ID NO: 638 - DNA, 491 bp, Homo sapiens
caggtgcagctggtgcagtctggggctgaggtaaagaagcctggggcctcggtgaaggtctcctgcaaggcttctggatacacgttcaccgactactttgtacactgggtgcgacaggtccctggacaaaattttgagtggatgggatggaccaacgtcaacactggtggcacaaactatgcaccaaagtttcagggcagggtcaccatgaccagggacacgtccatcagtacagcctacattgaactgagcggcctgacatctgacgacacggccgtttattattgtacgagagatgagttgttccgtgttgatgatgcctttgatatgtggggccaagggacactggtcaccgtctcttcagcctccaccaagggcccatcggccttccccctggcaccctcctccaagacgcacctctggggcacagcagccctgggctgcctggtcaaggactacttccccgaaccggtgacggtgtcgtggaactc

SEQ ID NO: 639 - DNA, 384 bp, Homo sapiens
caggtgcagctggtgcagtctggggctgaggtgaagaagcctggggcctcagtgatggtctcctgcaaggcttctggatacacattcatcgactactacatatactgggtgaggcaggcccctggacaagggcctgagtggatggggtggatcaacactaacaggggtggcacaaagtatgcacagaagtttcagggcagggtcaccctgaccagggacacggccgtcaccacggcctatctggagttgaacagcctgagatctgacgacacggccgtctattattgtgcgagactacaaagccttcatggactttactctaacgctgactactggggccagggacgctggtcaccgtctcctcagcctccaccaacgggccca

SEQ ID NO: 640 - DNA, 388 bp, Homo sapiens
caggtgcagctggtgcagtctggggctgaggtgaagaagcctggggcctcagtgaaggtctcctgccagacttctggatacacctccaccggccactatacacactgggtgcgacaggcccctggacaacgacctgagtggatgggatggatgaatcctaatagtggtggcacaacgtttgcaccgaaatttcagggcagaatcaccatgaccagggacacgtccaccagcacagcctacttggaggtgagaggtctgagggctgacgacacggccgtctattactgtgcgagagactattgtagtgggggtttctgccactacttctttgactcctggggccagggaaccctggtcaccgtctcctcagcctccaccaacgggccca

SEQ ID NO: 641 - DNA, 366 bp, Homo sapiens
caggtgcagctggtgcagtctgggcctgaagtgaagaagcctggggcctcagtgatggtctcctgcaaggcttctggatacaccttcatcgactactatatatactgggtgcgactggcccctggacaggggcttgagtggatgggatggatcaaccctaatagaggtggcacaaagtatgctcagaagtttcagggaaggatcaccatgaccagggacacggccgtcagcacggcctatatggagctgaccaccctgagatctgacgacacggccatgtactattgtgcgagactacaaagccttcatgggctttactctaacgctgactactggggccagggaacgctggtcaccgtctcctca

SEQ ID NO: 642 - DNA, 374 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcccacattgaactgagcggcctgacatctgacgacacggccgtttattattgtacgagagatgagttgttccgtgttgatgatgcctttgatatgtggggccaagggacactggtcaccgtctcttcagcctccaccaa

SEQ ID NO: 643 - DNA, 363 bp, Homo sapiens
caggtgcagctggtgcagtctggggctgacgtgaagaagcctggggcctcggtgaaggtctcctgcaaggcttctggatacacgttcaccgactactttgtacactgggtgcgacaggtccctggacaaaattttgagtggatgggatggaccaacgtcaacactggtggcacaaactatgcaccaaagtttcagggcagggtcaccatgaccagggacacgtccatcagtacagcctacattgaactgagcggcctgacatctgacgacacggccgtttattattgtacgagagatgagttgttccgtgttgatgatgcctttgatatgtggggccaagggacactggtcaccgtctcttca

SEQ ID NO: 644 - DNA, 423 bp, Homo sapiens
caggtgcagctggtgcagtctggggctgaggtgaagaagcctggggcctcagtgaaggtctcctgcaaggcttctggactcaccttcatcggctactatatgcactgggtgcgtcaggcccctggacaagggcttgagtggatgggatggatcaatcctaacaatggaaacacaaattatgcacagaagtttcgaggcagggtcaccatggccagggacacgtccatcagcacagcctacatggaactgaggggtctgaaatttgacgacacgtccatatattgctgtgcaatttcggcggacttttcgggcgtctccgactactactacatgggcgtctggggcaaagggaccacggtcaccgtctcctcaggagtgcatccgcccaaccctttcccctcgtcctcctctcgacgaattccc

SEQ ID NO: 645 - DNA, 464 bp, Homo sapiens
caggtgcagctggtgcagtctggggctgaggtgaagaagcctggggcctcagtgaaggtctcctgccagacttctggatacacctccaccggccactatacacactgggtgcgacaggcccctggacaacgacctgagtggatgggatggatgaatcctaatagtggtggcacaacgtttgcaccgaaatttcagggcagaatcaccatgaccagggacacgtccaccagcacagcctacttggagctgagaggtctgagggctgacgacacggccgtctattactgtgcgagagactattgtagtgggggtttctgccactacttctttgactcctggggccagggaaccctggtcaccgtctcctcagcctccaccaagggcccatcggtcttccccctggcaccctcctccaacgagcacctctggggcacagcggccctggctgcctggtcaggactact

SEQ ID NO: 646 - DNA, 335 bp, Homo sapiens
caggtgcagctggtgcagtctggggctgaggtgaagaagcctggggcctcaatgaaggtctcctgcaaggcttctggatacaccttcaacgactactatattcagtgggtgcgacaggcccctggacaaggtcttgagtggatgggatgtatcaatcctcagagtgatgacacaaagtatgcacagaaatttcaggggagggtcaccatgaccagggacacgtccaccaatacagcctacatggaactgagtggactgacatttgacgacacggccatgtattattgcctcactgcaatagatgggatcgtctactggggccagggacccctggt

SEQ ID NO: 647 - DNA, 374 bp, Homo sapiens
caggtgcagctggtgcagtctggggctgaggtaaagaagcctggggcctcggtgaaggtctcctgcaaggcttctggatacgcgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacactggtcaccgtctcttcagcctccaccaa

SEQ ID NO: 648 - DNA, 400 bp, Homo sapiens
caggtgcagctggtgcagtctggggctgaggtgaagaagcctggggcctcagtgaaggtctcctgccagacttctggatacacctccaccggccactatacacactgggtgcgacaggcccctggacaacgacctgagtggatgggatggatgaatcctaatagtggtggcacaacgtttgcaccgaaatttcagggcagaatcaccatgaccagggacacgtccaccagcacagcctacttggaggtgagaggtctgagggctgacgacacggccgtctattactgtgcgagagactattgtagtgggggtttctgccactacttctttgactcctggggccagggaaccctggtcaccatctcctcagcctccaccaaggcccatcggtcttccccct

SEQ ID NO: 649 - DNA, 377 bp, Homo sapiens
caggtgcagctggtgcagtctggggctgaggtgaagaagcctggggcctcagtgatggtctcctgcaaggcttctggatacacattcatcgactactacatatactgggtgaggcaggcccctggacaagggcctgagtggatggggtggatcaacactaacaggggtggcacaaagtatgcacagaagtttcagggcagggtcaccctgaccagggacacggccgtcaccacggcctatctggagttgaacagcctgagatctgacgacacggccgtctattattgtgcgagactacaaagccttcatggactttattctaacgctgactactggggccagggaacgctggtcaccgtctcctcagcctccaccaa

SEQ ID NO: 650 - DNA, 384 bp, Homo sapiens
caggtgcagctggtgcagtctggggctgaggtgaagaagcctggggcctcagtgaaggtctcctgcaaggcttctggatacaccttcaccacctactatatacactgggtgcgacaggcccctggacaagggcttgagtgggtgggatggttcaatcctaacagtggtggcgcacactatggactggactatcagggcagagtcactatgaccggggacacgtccatgaccacagtctacatggagttgaccaggctggcatccgacgacacggccatttattattgtgcgagagagggactttgtagaactaccagctgccaatttgactactggggccagggaacgctggtcaccgtcttctcagcctccaccaacgggccc

SEQ ID NO: 651 - DNA, 360 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaaacccggcgacacggccgtttatattgtgcgcgagacccccaagacggcactacttggtacacgcactggggccagggaacactggtcaccgtctcctca

SEQ ID NO: 652 - DNA, 373 bp, Homo sapiens
caggtgcagctggtgcagtctggggctgaggtgaagaagcctggggcctcagtgaaggtctcctgcaaggcttctggatacagtttcaccggctactatattcactggctgcgacagacccctggacaaggacctgagtggatgggatggatcaatcctaatactggtggcgcaaactatgcacccaattttgagggcagggtcaccatgaccagggacacgtccaccaagacagcctacatggaactgagcagactgagatctgacgacacggccttctactactgtgcggaggggggggttcttttaaggggttattattgttttcttttgatttcctggggtccagggaacgctggtgaccgtctcctca

SEQ ID NO: 653 - DNA, 377 bp, Homo sapiens
caggtgcagctggtgcagtctggggctgaggtgaagaagcctggggcctcagtgaaggtctcctgcaaggcttctggatacaggttcatcgactactatatacactgggtgcgacaggcccctggccaggggctcgactacatgggatggatcaaccctaagagtggtgacacaaactatgtaacgaagtttcagggcagggtcaccatgaccagggacacgtccatcagtacaggctacatggagatgaccgggctgatatctgacgacacggccgtctattactgtgcgaaaacaggtggaaagtacgctgactacctcgatattgactactggggccagggaaccctggtcaccgtctcctcaacctccaccaa

SEQ ID NO: 654 - DNA, 415 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaattatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacactggtcaccgtctcttcagcctccaccaaggcccatcggtcttccccctggccaccctcctccaacgacg

SEQ ID NO: 655 - DNA, 368 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaacccggcgacacggccgtttatcattgtgcgcgagacccccaagacggcactacttggtacacgcactggggccagggacactggtcaccgtctcctcagcctccacc

SEQ ID NO: 656 - DNA, 423 bp, Homo sapiens
caggtgcagctggtgcagtctggggcggaggtgaagaagcctggggcctcagtgaaggtctcctgccaggcttctggatacaccttcaccgactactatatacactgggtgcgacaggcccctggacaagggcttgagtggatgggatggatcaaccctaacagtggtggcacaaactatgcacagaagttccaaggcagactcacgattaccacggacgaatacacgaacacagcatatatggaattgagcagcctgagatctgaggacacggccgtgtattactgtgcgagagcccaagactctggttcggggaatttgatcaactggttcgacccctggggccagggaactctggtcaccgtctcctcagggagtgcatccgccccaacccttttcccctcgtctcctctgagaattccc

SEQ ID NO: 657 - DNA, 366 bp, Homo sapiens
caggtgcagctggtgcagtctggggctgaggtgaggaagcctggggcctcagtgaaggtctcctgcaaggcttctggatacagcttcagcgacttctatatacactgggtgcgacaggcccctggacaacgtcttgagtggatgggatggttcaaccctaacactggtggcgcacactctggactggactttcaggacagagtcaccatgaccggggacacgtccatcagcacagcctacatggaactgcccaggctggtatctgacgacacggccatttattactgtgcgagagagggacattgtcctaccaccagctgccattttgacttctggggccagggagcactggtcaccgtctcctca

SEQ ID NO: 658 - DNA, 371 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaattatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacacgtggtcaccgtctcttcacgcctcc

SEQ ID NO: 659 - DNA, 489 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacactggtcaccgtctcttcagcctccaccaaggcccatcggtcttccccctggcaccctcctccaagagcacctctggggcacagcagccctgggctgcctggtcaaggactacttcccgaaccggtgacggtgtcgtggaactcg

SEQ ID NO: 660 - DNA, 363 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacactggtcaccgtctcttca

SEQ ID NO: 661 - DNA, 362 bp, Homo sapiens
caggtgcagctggtgcagtctggggctgagatgaagaagcccggggcctcagtgaaggtctcctgcagggcttccggatacaggttcaacgactactatatgcactggttgcgacaggcccctggacaaggccctgagtggatgggttggatcaaccccaaacaatggtggcacaaaattatgcacagaggtttgagggcagggtcaccatgacctgggacaggtccatcaacacagcccacatggacctgaacaggctgatatctgacgacacggccgtttactactgtgcgagaggatttttccgcggttcggggagatatcccttccactttgacctcgtggggccagggaacgctggt

SEQ ID NO: 662 - DNA, 372 bp, Homo sapiens
caggtgcagctggtgcagtctggggctgaggtgaagaagcctggggcctcagtgaaggtctcctgcaaggcttctggactcaccttcatcggctactatatgcactgggtgcgtcaggcccctggacaagggcttgagtggatgggatggatcaatcctaacaatggaaacacaaattatgcacagaagtttcgaggcagggtcaccatggccagggacacgtccatcagcacagcctacatggaactgaggggtctgaaatttgacgacacgtccatatattactgtgcaatttcggcggacttttcgggcgtctccgactactactacatgggcgtctggggcaaagggactgcggtcaccgtctcctca

SEQ ID NO: 663 - DNA, 363 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaattatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacactggtcaccgtctcttca

SEQ ID NO: 664 - DNA, 411 bp, Homo sapiens
caggtgcagctggtgcagtctggggctgaggtaaagaagcctggggcctcggtgagggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccaacagcacagcctacattgaactgagcggcctgacatctgacgacacggccgtttattactgtgcgagagacccccaagaaggcagcagctggtacacgcactggggccagggaacgctggtcaccgtctcctcagcctccaccaacgggcccatcggtcttcccccgtggccaccctcctccaac

SEQ ID NO: 665 - DNA, 398 bp, Homo sapiens
caggtgcagctggtgcactctggggctgaggtgaagaagcctggggcctccgtgaaggtctcctgtcagacttctggatacacgttcagcgactactttctccactgggtgcgacaggcccctggacaagggcttgagtggatggcatggatcaaccctactaatggtgacacaaactttgcacagacgtttcagggcagggtcaccgtgaccagggacacgtccattagcacagtctacatggagctcagcagtctgaagtctgacgacacggccgtgtatttctgtgcgagaggagtccggcgctatagtggcagctggtacttggggtactggggccagggaaccctggtcaccgtctcctcagcctccaccaagggcccatccggtcttccccc

SEQ ID NO: 666 - DNA, 367 bp, Homo sapiens
caggtgcagctggtgcagtctggggctgaggtgaagaagcctggggcctcagtgaaagtctcctgcaaggcttctggatacagtttcagcgactaccatctacactgggtgcgacaggcccctggacaagggcttgagtggatgggatggatcaaccataatggcggtggcgcaacctatgcacagaagttccagggcagagtcgccatgaccagggacacgtccatcagcacagtctttatggaattgagcaggctgcgatttgacgacacggccgtgtattactgtgcgagctcagtgggagccgatttctgctttgactactggggccagggaacgctggtcaccggtctcctcagggagtgca

SEQ ID NO: 667 - DNA, 447 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacactggtcaccgtctcttcagcctccaccaacggcccatccggtcttccccctggccgccctgcctccacggacgccacctccgacgagccacgacgccggccc

SEQ ID NO: 668 - DNA, 363 bp, Homo sapiens; identical to SEQ ID NO: 660

SEQ ID NO: 669 - DNA, 353 bp, Homo sapiens
caggtgcagctggtgcactctggggctgaggtgaagaagcctggggcctccgtgaaggtctcctgtcagacttctggatacacgttcagcgactactttctccactgggtgcgacaggcccctggacaagggcttgagtggatggcatggatcaaccctactaatggtgacacaaactttgcacagacgtttcagggcagggtcaccgtgaccagggacacgtccattagcacagtctacatggagctcagcagtctgaagtctgacgacacggccgtgtatttctgtgcgagaggagtccggcgctatagtggcagctggtacttggggtactggggccagggaaccctggt

SEQ ID NO: 670 - DNA, 375 bp, Homo sapiens
caggtgcagctggtgcactctggggctgaggtgaagaagcctggggcctccgtgaaggtctcctgtcagacttctggatacacgttcagcgactactttctccactgggtgcgacaggcccctggacaagggcttgagtggatggcatggatcaaccctactaatggtgacacaaactttgcacagacgtttcagggcagggtcaccgtgaccagggacacgtccattagcacagtctacatggagctcagcagtctgaagtctgacgacacggccgtgtatttctgtgcgagaggagtccggcgctatagtggcagctggtacttggggtactggggccagggaaccctggtcaccgtctcctcagcctccacc

SEQ ID NO: 671 - DNA, 350 bp, Homo sapiens
caggtgcagctggtgcaatctggggctgaagtgaagaagcctggggcctcagtgatggtctcctgcaaggcttctggatacaccttcatcgactactatatatactgggtgcgacaggcccccggagaagggcttgagtggatgggatggatcaaccctaacagaggtggcaacaaagtatgcacagaagtttcgggaccgggtcaccatgaccagggacacggccgtcagcacggcctatatggaactgaacagcctgagatctgacgacacggccgtctactactgtgcgagacttcagagccttagtgggtctttactctaacgctgactacgtggggccagggaac

SEQ ID NO: 672 - DNA, 414 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggacccaacgtcaacactggtggcacaaattatgcaccaaagtttcagggcagggtcaccatgaccagggacacgtccatcagcacagcctacattgaactgagcggcctgacatctgacgacacggccgtttatactgtgcgagaggagattatgattacctttggggaaattatcgttttgaatactggggccagggaaccctggtcaccgtctcctcagcctccaccaagggcccatcggtcttccccctggcaccctcctcc

SEQ ID NO: 673 - DNA, 365 bp, Homo sapiens
caggtgcagctggtgcagtctggggctgaggtgaagaagcctggggcctcagtgaaggtctcctgcaaggcttctggatacaggttcatcgactactatatacactgggtgcgacaggcccctggccaggggctcgactacatggggtggatcaaccctaagagtggtgacacaaactatgtaacgaagtttcagggcagggtcaccatgaccagggacacgtccatcagtacaggctacatggagatgaccgggctgatatctgacgacacggccgtctattactgtgcgaaaacaggtggaaagtacgctgactacctcgatattgactactggggccagggaaccctggtcaccgtctcctc

SEQ ID NO: 674 - DNA, 377 bp, Homo sapiens
caggtgcagctggtgcagtctggggctgaggtgaagaagcctggggcctcagtgaaggtctcctgcaaggcttctggatacaggttcatcgactactatatacactgggtgcgacaggcccctggccaggggctcgactacatggggtggatcaaccctaagagtggtgacacaaactatgtaacgaagtttcagggcagggtcaccatgaccagggacacgtccatcagtacaggctacatggagatgaccgggctgatatctgacgacacggccgtctattactgtgcgaaaacaggtggaaagtacgctgactacctcgatattgactactggggccagggaaccctggtcaccgtctcctcaacctccaccaa

SEQ ID NO: 675 - DNA, 374 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaactatgcaccaaagtttcagggcagagtcaccatgaccagggacacgtccatcagcacagcctacattgaactgagcggcctgacatctgacgacacggccgtttattattgtacgagagatgagttgttccgtgttgatgatgcctttgatatgtggggccaagggacactggtcaccgtctcttcagcctccaccaa

SEQ ID NO: 676 - DNA, 365 bp, Homo sapiens; identical to SEQ ID NO: 673

SEQ ID NO: 677 - DNA, 374 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacactggtcaccgtctcttcagcctccaccaa

SEQ ID NO: 678 - DNA, 378 bp, Homo sapiens
  misc_feature (297)..(297): n is a, c, g, or t
caggtgcagctggtgcagtctggggctgaggtgaagaagcctggggcctcagtgaaggtctcctgcaaggcttctggatacaggttcatcgactactatatacactgggtgcgacaggcccctggccaggggctcgactacatggggtggatcaaccctaagagtggtgacacaaactatgtaacgaagtttcagggcagggtcaccatgaccagggacacgtccatcagtacaggctacatggagatgaccgggctgatatctgacgacacggccgtctattactgtgcgaaaacnggtggaaagtacgctgactacctcgatattgactactggggccagggaaccctggtcaccgtctcctcaacctccaccaac

SEQ ID NO: 679 - DNA, 364 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacacgtggtcaccgtctcttca

SEQ ID NO: 680 - DNA, 363 bp, Homo sapiens; identical to SEQ ID NO: 660

SEQ ID NO: 681 - DNA, 384 bp, Homo sapiens
caggtgcagctggtgcaatctggggctgaagtgaggaagcctggggcctcagtgaaagtctcctgcaaggcttctggatatatcttcaccggccactatatgaactgggtgcgagaggcccctggacaaggtcttgagtggatgggatggatcaaccctgacagtggaggcacaaaatatgcagaacagtttcagggcagggtcaccacgaccagggacacgtccatcaacacagtctacatggagctgagcagcctcagatctgacgacacggccatatattattgtgcgcgattgtttgtagtagttccagtctactttttccggtgaaataactgtcttttgatatcgtggggccaagggacaacggtcaccgtctcttca

SEQ ID NO: 682 - DNA, 414 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacactggtcaccgtctcctcagggagtgcatccgccccaacccttttcccctcgtctcctctgagaattccc

SEQ ID NO: 683 - DNA, 420 bp, Homo sapiens
caggtgcagctggtgcagtctggggctgaggtaaagaagcctggggcctcggtgaaggtctcctgcaaggcttctggatacacgttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgaattgttccgtgttgatgatgcctttgatatgtggggccaagggacactggtcaccgtctcttcagcctccaccaacgggcccatcggtccttcccccgtcggccaccctcctccaacgacg

SEQ ID NO: 684 - DNA, 365 bp, Homo sapiens
caggtgcagctgctacagtctggggctgaggtgaagaagcctggggcctcagtgatggtctcctgcaaggcttctggatacaccttcatcgactactacatatactgggtgcggcaggcccctggacaagggcttgagtggatgggatggatcaaccctaacagaggtggcaccaagtatgcacagaagtttcagggcagggtcaccttgaccagggacacggccgtcaccacggcctatctggaggtgaacagcctgagatctgacgacacggccgtctattattgtgcgagactacaaagccttcatggattttactctaacgctgactactggggccagggacgctggtcaccgtctcctca

SEQ ID NO: 685 - DNA, 414 bp, Homo sapiens
caggtgcagctggtgcagtctggggctgaggtgaagaagcctggggcctcagtgaaggtctcctgcaaggcctctggatacagtttcagcgactaccatatacactgggtgcgacaggcccctggacaagggcttgagtggatgggatggatcaaccagaatggtggtggcgcaacacatgtacagaagttccagggcagggtcgccatgaccagggacacgtccatcagcacagcctttatggagctgagcaggctgagatttgacgacacggccatatattattgtgcgcgagccctgaggccagtggctgacgcgcttgagcttgactattggggccgagggaacgctggtcaccgtctcgtcacgcctccaccaacgggcccagtccggtccttcccccgtcggccaccc

SEQ ID NO: 686 - DNA, 415 bp, Homo sapiens
caggtgcagctggtgcagtctggagctgaggtgaagaagcctggggcctcagtgaaggtctcctgcaaggcttctggttacacctttaccagctatggtatcagctgggtgcgacaggcccctggacaaggccttgagtggatgggatggatcaatcctaacaatgatggcacaacctatgcacacaaatttcagggcagggtcaccgtgaccagggacacgtccattagtacggcctacatggagctgagcggactgagatctgacgacacggccatttattactgtgcgagagcgccatacagcgcactatacttctacatggacgtctggggcaaagggaccacggtcaccgtctcctcagggagtgcatccgccccaacccttttcccctcgtctcctctgagaattcccc

SEQ ID NO: 687 - DNA, 368 bp, Homo sapiens
caggtgcagctggtgcagtctggggctgaggtgaagaagcctggggcctcagtaaaggtctcctgcaaggcttctggatacaccttcagcgcctactatctacactgggtgcgacaggcccctggacaagggcttgagtggatgggatgcatcaaccctaatagtggtgccacaatttacgcaccgaagtttcagggcagggtcaccttgaccacggacacgtccatcagcacgaccttcatggagatgagcggactgacatatggcgacacggccgtatattattgttcgagagatcacgctgaaatcttgactgattattatatagtggactactggggccaggggaccctggtcaccgtctcctc

SEQ ID NO: 688 - DNA, 400 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacactggtcaccgtctcctcagcctccaccaagggcccatccggtccttcccccgtggccg

SEQ ID NO: 689 - DNA, 382 bp, Homo sapiens
caggtgcagctggtgcagtctggggctgaggtgaagaagcctggggcctcagtgaaggtctcctgcaaggcctctggatacagtttcagcgactaccatatacactgggtgcgacaggcccctggacaagggcttgagtggatgggatggatcaaccagaatggtggtggcgcaacacatgtacagaagttccagggcagggtcgccatgaccagggacacgtccatcagcacagcctttatggagctgagcaggctgagatttgacgacacggccatatattattgtgcgcgagccctgaggccagtggctgacgcgcttgagcttgactattggggccagggaacgctggtcaccgtctcctcagggagtgcatccgccc

SEQ ID NO: 690 - DNA, 366 bp, Homo sapiens
caggtgcagctggtgcagtctggggctgaggtgaagaagcctggggcctcagtgaaggtctcctgcaaggcctctggatacagtttcagcgactaccatatacactgggtgcgacaggcccctggacaagggcttgagtggatgggatggatcaaccagaatggtggtggcgcaacacatgtacagaagttccagggcagggtcgccatgaccagggacacgtccatcagcacagcctttatggagctgagcaggctgagatttgacgacacggccatatattattgtgcgcgagccctgaggccagtggctgacgcgcttgagcttgactattggggccagggaacgctggtcaccgtctcgtca

SEQ ID NO: 691 - DNA, 366 bp, Homo sapiens
  misc_feature (319)..(319): n is a, c, g, or t
caggtgcagctgctacagtctggggctgaggtgaagaagcctggggcctcagtgatggtctcctgcaaggcttctggatacaccttcatcgactactacatatactgggtgcggcaggcccctggacaagggcttgagtggatgggatggatcaaccctaacagaggtggcaccaagtatgcacagaagtttcagggcagggtcaccttgaccagggacacggccgtcaccacggcctatctggaggtgaacagcctgagatctgacgacacggccgtctattattgtgcgagactacaaagccttcatggattttacnctaacgctgactactggggccagggaacgctggtcaccgtctcctca

SEQ ID NO: 692 - DNA, 383 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacactggtcaccgtctcctcagcctccaccaaggcccatcggtc

SEQ ID NO: 693 - DNA, 415 bp, Homo sapiens
caggtgcagctggtgcagtctggggctgaggtgaagaagcctggggcctcagtgaaggtctcctgcaaaatttctggatacaccttcaccaagttctacatacactgggtgcgacaggcccctgggcaagggcttgagtggttgggatggatcaaccctaacaatggtggcacaaagtctgcacagcagtttcagggcagggtcgccttgaccagggacacgtccctcagcacagcctatattgaactgagcagcctgacatctgacgacacggccgtttattactgtgcgagaggagattatgattacctttggggaaattatcgttttgaatactggggccagggaaccctggtcaccgtctcctcagcctccaccaaggcccatcggtcttccccctggccgccctcgctcc

SEQ ID NO: 694 - DNA, 423 bp, Homo sapiens
caggtgcagctggtgcagtctggggctgaagtgaagaagcctggggcctcagtgaaggtctcctgcaagacctctggatacaccttcaccgacaattatatacactgggtgcgccaggcccctggacaagggcttgagtggatgggatggatcaaccctaatagtggtggctcaaagtctccacagaagtttcagggcagggtcaccatgaccagggacacgtccgtcagtacagtctacttggaattgaccaggctgaaatttgacgacacggccatttattactgtacgaaagattatggcatagtgggatctactctacccgaatacttccaacactggggccagggcaccctggtcaccgtctcctcacgcctccaccaacggcccatccggtcttccccctcggccaccctcctccaa

SEQ ID NO: 695 - DNA, 427 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacactggtcaccgtctcctcagcctccaccaagggcccatccggtccttcccccgtggccgccctgcctcccaggacgccacctccga

SEQ ID NO: 696 - DNA, 366 bp, Homo sapiens; identical to SEQ ID NO: 690

SEQ ID NO: 697 - DNA, 403 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacactggtcaccgtctcctcagcctccaccaagggcccatccggtcttccccctggccgccctg

SEQ ID NO: 698 - DNA, 369 bp, Homo sapiens
caggtgcagctggtgcagtctggggctgaggtgaagaagcctggggcctcagtgaaggtctcctgcaaggcctctggatacagtttcagcgactaccatatacactgggtgcgacaggcccctggacaagggcttgagtggatgggatggatcaaccagaatggtggtggcgcaacacatgtacagaagttccagggcagggtcgccatgaccagggacacgtccatcagcacagcctttatggagctgagcaggctgagatttgacgacacggccatatattattgtgcgcgagccctgaggccagtggctgacgcgcttgagcttgactattggggccagggaacgctggtcaccgtctcgtcagcc

SEQ ID NO: 699 - DNA, 391 bp, Homo sapiens
caggtgcagctggtgcagtctggggctgaagtgaagaagcctggggcctcagtgaaggtctcctgcaaggcttctggatacatcttcaacaactactttttgcactgggtgcgacaggcccctggacaggggcttgagtggatggggtggatcaaccctaacactgctggcacaaactatgcatacaactttcggggcagggtcagcatgaccagggacacgtccaccggaacagcctacatggagctgagcaggctgagatctgacgacacggccgtgtatttctgtgcttcatgcgagcggggtgtagttggtgttacgacgttagggacggggggctacgtacgccagtggacgtcgtggggccaagggacccacggtcgccgtctcc

SEQ ID NO: 700 - DNA, 367 bp, Homo sapiens
caggtgcagctggtgcagtctggggctgaggtgaagaagcctggggcctcagtgaaggtctcctgcaaggcctctggatacagtttcagcgactaccatatacactgggtgcgacaggcccctggacaagggcttgagtggatgggatggatcaaccagaatggtggtggcgcaacacatgtacagaagttccagggcagggtcgccatgaccagggacacgtccatcagcacagcctttatggagctgagcaggctgagatttgacgacacggccatatattattgtgcgcgagccctgaggccagtggctgacgcgcttgagcttgactattggggccgagggaacgctggtcaccgtctcgtca

SEQ ID NO: 701 - DNA, 366 bp, Homo sapiens; identical to SEQ ID NO: 691
  misc_feature (319)..(319): n is a, c, g, or t

SEQ ID NO: 702 - DNA, 410 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagagtcacgattagcacggacgaatccacggccaccgtttatatggaattgagcagcctcagatttgaagacacggccatatattactgtgcgagagataggttctatggttcgggaagttatgtctactggggccagggaacgctggtcaccgtctcctcagggagtgcatccgccccaaccctttcccctcgtctcctctgagaattccc

SEQ ID NO: 703 - DNA, 362 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacaccggtcaccgtctcctcacg

SEQ ID NO: 704 - DNA, 371 bp, Homo sapiens
caggtgcagctggtgcagtctggggctgaggcgaagaagcctggggtctcagtgaaggtctcctgcaagacttctggatacattttcaccggcttctatattcactgggtgcgacaggcccctggacaggggcttgagtggatgggatggatcaaccctaaaactggtggcgcaaactatgcacagaagtttcagggaagagtcaccatgaccagggacatgcccatcaggacaatcttcatggagttgagtagtctgggatccgacgacacggccgtgtattattgcgcgagagagtaggggggttgaaggttactagtggttcgggagttgcaatactggggccagggaacgctggtcaccgtctcctc

SEQ ID NO: 705 - DNA, 375 bp, Homo sapiens
caggtgcagctggtgcagtctggggctgaagtgaagaagcctggggcctcagtgaaggtctcctgcaagacctctggatacaccttcaccgacaattatatacactgggtgcgccaggcccctggacaagggcttgagtggatgggatggatcaaccctaatagtggtggctcaaagtctccacagaagtttcagggcagggtcaccatgaccagggacacgtccgtcagtacagtctacttggaattgaccaggctgaaatttgacgacacggccatttattactgtacgaaagattatggcatagtgggatctactctacccgaatacttccaacactggggccagggcaccctggtcaccgtctcctcagcc

SEQ ID NO: 706 - DNA, 375 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagttccagggcagactcacgattaccgcggacgagtccacgaacacgggttacatggaacttgacaacctgcgatctgacgacacggccatatattactgtgcgcgaggacggactgtccacccatttgaatactactattactatatggacgtctggggcaaagggaccacggtcaccgtcacttca

SEQ ID NO: 707 - DNA, 366 bp, Homo sapiens
caggtgcagctggtgcagtctggggcggaggtgaagaagcctggggcctcagtgaaggtctcctgccaggcttctggatacaccttcaccgactactatatacactggctgcgacaggcccctggacaagggcttgagtggatgggatggatcaaccctaacagtggtggcgcacactatggactggactatcagggcagagtcacgatgaccggggacacgtccatcaccacagtctacatggagttgaccagactggcatccgacgacacggccatttattattgtgcgagagagggactttgtggaactaccagctgccaatttgacttctggggccagggaacgctggtcaccgtcttctca

SEQ ID NO: 708 - DNA, 370 bp, Homo sapiens
caggtgcagctggtgcagtctggggctgaggtgaagaagcctggggcctcagtgaaggtctcctgcaaggcctctggatacagtttcagcgactaccatatacactgggtgcgacaggcccctggacaagggcttgagtggatgggatggatcaaccagaatggtggtggcgcaacacatgtacagaagttccagggcagggtcgccatgaccagggacacgtccatcagcacagcctttatggagctgagcaggctgagatttgacgacacggccatatattattgtgcgcgagccctgaggccagtggctgacgcgcttgagcttgactattggggccagggaacgctggtcaccgtctcctcaggga

SEQ ID NO: 709 - DNA, 373 bp, Homo sapiens
caggtgcagctggtgcagtctggggctgaggtaaagaagcctggggcctcggtgaaggtctcctgcaaggcttctggatacaccttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtttattattgtacgagagatgagttgttccgtgttgatgatgcctttgatatgtggggccaagggacacgtggtcaccgtctcttcagcctccacc

SEQ ID NO: 710 - DNA, 486 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacactggtcaccgtctcctcagcctcaccaagggcccatccggtcttccccctggccgccctgcctccaggacgcacctccgagacgcacagccggccctgggctgcctggtcaaggactaccttcccgaaccggtgacggtgtcgt

SEQ ID NO: 711 - DNA, 378 bp, Homo sapiens
caggtgcagctggtgcagtctgggtctgaggtgaagaagcctggggcctcagtgaaggtctcctgcaaggcttccggatacaccttcaccacctactatatacactgggtgcgacaggcccctggacaagggcttgagtgggtgggatggttcaatcctaacagtggtggcgcacactttggactggactttcagggcagagtcaccatgaccggggacacgtccatcagcacagtctacatggacctgaccagcctggcatctgtcgacacggccatttattactgtgcgagagagggacgctgtcctactaccagctgccattttgactactggggccagggaacgctggtcaccgtctcctcacgcctccaccaa

SEQ ID NO: 712 - DNA, 431 bp, Homo sapiens
caggtgcagctggtgcagtctggggttgaggtgaagaaacctggggcctcaatgaaggtctcctgcaaggcttctggatacaatttcaccggctactttatccactgggtgcgacagggccctggacaagggcttgagtggatgggatggatgaacccaaacaccggtggcgcaaagtatgcacagaagtttcagggcagggtcaccatgaccagggacacatccatcagaacagcctacatggaactgagcagcctaaaacccggcgacacggccgtttattattgtgcgcgagacccccaagacggcactacttggtacacgcactggggccagggaacactggtcaccgtctcctcacgcctccaccaagggcccatcggtccttcccccgtggccgccctgcctccgaggacgccacctccgagacg

SEQ ID NO: 713 - DNA, 369 bp, Homo sapiens
caggtgcagctggtgcagtctggggctgaggtgaagaagcctgggtcctcggtgaaggtctcctgcaaggcttctggatacaccttcagcgcctactatctacactgggtgcgacaggcccctggacaagggcttgagtggatgggatgcatcaaccctaatagtggtgccacaatttacgcaccgaagtttcagggcagggtcaccttgaccacggacacgtccatcagcacgaccttcatggagatgagcggactgacatatggcgacacggccgtctattactgtgcgagaaataccgactcagtggctacctctttgtacagtttgggcgtctggggccaagggaccacggtcaccgtctcctca

SEQ ID NO: 714 - DNA, 372 bp, Homo sapiens
caggtgcagctggtgcagtctggggctgaagtgaagaagcctggggcctcagtgaaggtctcctgcaagacttctggatacagcttcaccggcaactatatacactgggtgcgccaggcccctggacaagggcttgagtggatgggatggatcaaccctaatagtggtggctcaaagtctccacagaagtttcagggcagggtcaccatgaccagggacacgtccgtcagtacagtttacttggaattgaccaggctgaaatttgacgacacggccatatattactgtacgaaagattatggcatagtgggatctactctacccgaatacttccaacactggggccagggcaccctggtcaccgtctcctca

SEQ ID NO: 715 - DNA, 413 bp, Homo sapiens
caggtgcagctggtgcaatctggggctgaggtgaagaagcctggggcctcagtgaaggtctcctgcaaggcttctagatacacggtcaccggctattttatccactgggtgcgacaggcccctggacaagggctggagtggatgggttggatcaagcctaacagtgagagcacaaactatgcacagaagttccagggcagagtcacgattaccgcggacgaatccacgagcacagcctacatggagctgagcagcctgagatctgaggacacggccgtgtattactgtgcgagttcgagagcagccggaggctactactactactacatggacgtctggggcaaagggaccacggtcaccgtctcctcagggagtgcatccgccccaacccttttccccctcgtctcctctga

SEQ ID NO: 716 - DNA, 421 bp, Homo sapiens
caggtgcagctggtgcagtctggggctgcggtgaagaagccggggtcgtcggtgaaggtctcctgcaaggcttctggaggcgtcttcactaagtatgacatcaactgggtgcgacagggcccctggacaagggcttgagtggatgggatggatcaaccctaacagtggtggcacaaactatgcacagaaatttcaggggcagggtcaccatgaccagggacacgtccatcaccacagcctacatggagctgagcaggctgacatctgacgacacggccgtatattactgtgcgcgcctgtatagtacctcgtcctctcccttgtcggggctttgactggggccagggaaccctggtcaccgtctcctcagggagtgcatccgccccaacccttttccccctcgtctcctctgagaattccc

SEQ ID NO: 717 - DNA, 354 bp, Homo sapiens
caggtgcagctggtgcagtctggggctgaggtgaagaatcttggggcctccgtgaaggtctcctgcaaggtttccggacacaccctcactgacttatccttacactgggtgcgacaggcccctggaaaagggcttgagtggatgggaggttttgatccggaagatgaagaaacaatctacgcacaggagttccagggcagaatcatcatgaccgaggacacatctacagacacagcctacatggaactgagcagcctgagatctcacgacacggccgtatattattgtgcagtttcagcctatgacacttctctagactactggggccagggcacgctggtcaccgtctcctca

SEQ ID NO: 718 - DNA, 372 bp, Homo sapiens
caggtgcagctggtgcagtctggggctgaagtgaagaagcctggggcctcagtgaaggtctcctgcaagacttctggatacagcttcaccggcaactatatacactgggtgcgccaggcccctggacaagggcttgagtggatgggatggatcaaccctaatagtggtggctcaaagtctccacagaagtttcagggcagggtcaccatgaccagggacacgtccgtcagtacagtttacttggaattgaccaggctgaaatttgacgacacggccatatattactgtacgaaagattatggcatgttgggatctactctacccgaatacttccaacactggggccagggcaccgtggtcaccgtctcctca

SEQ ID NO: 719 - DNA, 343 bp, Homo sapiens
caggtgcagctggtgcagtctggggctgaggtgaagaagcctggggcctcagtgaaggtctcctgcaaggtttccggatacttcctctctaaattatccatgcactgggtgcgacaggctcctggaaaggggcttgagtggatgggaggcttcaatcctggagaaggtgaaacaatctacgcacagaggttccagggcagagtcaccattaccgaggacatttccacagacacagcctacatggaactgagcagcctgagatctgaggacacggccgtgtatttttgtgcaacgggtataacagtggttagcgtgtatcttgactactggggccagggaaccc

SEQ ID NO: 720 - DNA, 459 bp, Homo sapiens
caggtgcagctggtgcagtctggggctgagatgaagaagcctggggcctcagtgaaggtctcctgcaagacttctggatacaccttcaccgactactatttccactggctgcgacaggcccctggacaagggcttgagtggatgggatggctcgtccctaacactggtggcacaaactatgcactaaattttcagggcagggtcgccatgaccagggacacgtccatcagcacagtctacatggaattgcgtcgcctcagatctgacgacacggccgtctattattgtgtgagagacggcggccggcggttgggcggcagctggtacccaaattttgacaagtggggccagggaacacttatcaccgtctcctcagcctccaccaaggcccatcggtcttccccctggcaccctcctccaagagcacctctggggcacagcgccctgggctgcctggtc

SEQ ID NO: 721 - DNA, 366 bp, Homo sapiens
caggtgcagctggtacaatctggggctgaagtgaagaagcctggggcctcagtgatggtctcctgcaaggcttctggatacaccttcatcgactactatatatactgggtgcgacaggcccctggacgagggcttgagtggatgggatggatcaaccctaacagaggtggcacaaagtatgcacagaagtttcgggaccgggtcaccatgaccagggacacggccgtcagcacggcctatatggaactgaacagcctgagatctgacgacacggccgtctactactgtgcgagacttcagagccttagtgggctttactctaacgctgactactggggccagggaacgctggtcaccgtctcctca

SEQ ID NO: 722 - DNA, 382 bp, Homo sapiens
caggtgcagctggtgcagtctggggctgaggtgaagaagcctggggcctcagtgaaggtctcctgcaaggcttctggatacaccttcatcgacttctatatacactgggtgcgacaggcccctggacaacgtcttgagtggatgggatggttcaatcctaacactggtggcgcacactctggactggactttcagggcagagtcaccatgaccggggacacgtccatcagcacagcctacatggaactgcccaggctggcatctgacgacacggccatttattactgtgcgagagagggacattgtcgtaccaccagctgccattttggcttctggggccagggagcactggtcaccgtctcctcagcctccaccaaggccc

SEQ ID NO: 723 - DNA, 371 bp, Homo sapiens
caggtgcagctggtgcagtctggggctgaggtgaagaagcctggggcctcagtgaaggtctcctgcaaggcctctggatacaccttcagcggctactactacattcactgggtgcgacaggcccctggacaagggcttgagtggatgggacggatcaatcctaacactggtggcacagactatgcacagaaatttcagggcagggtcaccatgaccagggacacgtccatgaacactctttacttagaattgagcaggctgacatctgacgacacggccgtttattactgtgcgacaattcagcggctggttaaggacttggactactggggccagggaacgctggtcaccgtctcctcagcctccaccaa

SEQ ID NO: 724 - DNA, 354 bp, Homo sapiens
caggtgcagctggtgcagtccggggttgaggtgaagaagcctggggcctcagtgaaggtctcctgcaaggtttccggatacttcctcagtaaaatttccatccactgggtgcgacaggctcctgaaaaagggctcgagtggatgggaggttttgatgctgaacaaggtgaaacagtctacgcacagaagttccagggcagagtcaccgtaaccgaggacacgtctacagacacagcctacatggacgtgagcagtctgagatctgaggacacggccgtttattactgtgcaacaggaatccgtgggcgtcctttgatatcgtggggccaagggacagtggtcaccgtctcttca

SEQ ID NO: 725 - DNA, 376 bp, Homo sapiens
caggtgcagctggtgcagtctgggcctgaggtgaagaagcctggggcctcagtgaaggtctcctgtaaggcttctggatacacctacaatacctactatatgcactgggtgcgacaggcccctggacaagggcttgagtggatgggatggatcaaccctaatagtggtggcacaaactatgcacagagatttcagaccagggtcgacatgaccaggggcacgtccataaacacagtctacatggagctgagcggactgacatctgacgacacggccgtgtattattgtgtgactgatttcaacgggggtagtagtttttccttttactacttttgacctacgtggggccagggaacgcgtggtcaccgtctcctca

SEQ ID NO: 726 - DNA, 386 bp, Homo sapiens
caggtgcagttggtgcaatctggggctgaagtgaagaagcctggggcctcagtgatggtctcctgcaaggcttctggatacaccttcatcgactactatatatactgggtgcgacaggcccctggacgagggcttgagtggatgggatggatcaaccctaacagaggtggcacaaagtatgcacagaagtttcgggaccgggtcaccatgaccagggacacggccgtcagcacggcctatatggaactgaacagcctgagatctgacgacacggccgtctactactgtgcgagacttcagagccttagtgggctttactctaacgctgactactggggccagggaacgctggtcaccgtctcctcacgcctccaccaacgggccca

SEQ ID NO: 727 - DNA, 364 bp, Homo sapiens
caggtgcagctggtgcaatctggggctgaggtgaagaagcctggggcctcagtgaaggtctcctgcaaaatttctggatacaccttcaccaagttctacatacactgggtgcgacaggcccctggacaagggcttgagtggttgggatggatcaaccctaacaatggtggcacaaagtctgcacagcagtttcagggcagggtcgccttgaccagggacacgtccctcagcacagcctatattgaactgagcagcctgacatctgacgacacggccgtttattactgtgcgagaggagattatgattacctttggggaaattatcgttttgaatactggggccagggaaccctggtcaccgtct

SEQ ID NO: 728 - DNA, 377 bp, Homo sapiens
caggtgcagctggtgcagtctggggctgaggtgaagaagcctggggcctcagtgaaggtctcctgccagacttctggatacacctccaccggccactatacacactgggtgcgacaggcccctggacaacgacctgagtggatgggatggatgaatcctaatagtggtggcacaacgtttgcaccgaaatttcagggcagagtcaccattaccaggaacacctccataagcacagcctacatggagctgagcagcctgagatctgaggacacggccgtgtattactgtgcgagaggaaagtgggagcaattgggcgcttttgatatctggggccaagggacaatggtcactgtctcttcagggagtgcatccgcccc

SEQ ID NO: 729 - DNA, 372 bp, Homo sapiens
caggtgcagctggtgcagtctggggcggaggtgaagaagcctggggcctcagtgaaggtctcctgccaggcctctggatacaccttcaccgactactatatacactggctgcgacaggcccctggacaagggcttgagtggatgggatggatgaatcctaatagtggtggcacaacgtttgcaccgaaatttcagggcagaatcaccatgaccagggacacgtccaccagcacagcctacttggaggtgaggggtctgagggctgacgacacggccgtctattactgtgcgagagactattgtagtggggtttctgccactacttctttgactccgtggggccagggaaccctggtccaccgtctcctcacg

SEQ ID NO: 730 - DNA, 372 bp, Homo sapiens
caggtgcagctggtgcagtctgggcctgaggtgaagaagcctggggcctcagtgaaggtctcctgtaaggcttctggatacacctacaatacctactatatgcactgggtgcgacaggcccctggacaagggcttgagtggatgggatggatcaaccctaatagtggtggcacaaactatgcacagagatttcagaccagggtcgacatgaccagggacacgtccataaacacagtctacatggagctgagcggactgacatctgacgacacggccgtgtattattgtgtgactgatttcaacgggggtagtagttttccttttactactttgaccacgtggggccagggaacgctggtcaccgtctcctca

SEQ ID NO: 731 - DNA, 376 bp, Homo sapiens
caggtgcagctggtgcagtctggggctgaggtgaagaagcctggggcctcggtgaaggtctcctgcaaggcttctggatacaccttcaccgactactttgtacactgggtgcgacaggcccctggacaaaattttgagtggatgggatggaccaacgtcaacactggtggcacaaagtatgcaccaaagtttcagggcagggtcaccatgaccagggacacgtccatcagcacagcctacattgaactgagcggcctgacatctgacgacacggccgtgtattactgtgcgagagatatgagcagcagctggaccaactggtacttcgatctctggggccctggcacctggtcactgtctcctcagcctccaccaa

SEQ ID NO: 732 - DNA, 384 bp, Homo sapiens
caggtgcagctggtgcagtctggggctgaggtgaagaagcctggggcctcagtgaaggtctcctgtaaggcttctggatacacctacatcaactactttatgcagtgggtgcgacaggcccctggacaagggcttgagtggatgggatggatcaaccctaacagtggtctcacaaactacgcacagaagtttcggggcagggtcaccatggccagggacacgtccatcaacacagcctacatggagttgaggggactgaggatctgacgacacggccgtctattactgtacttcctgcgaccggggtggtagtagatcgttacgatttacaaggggggggctacgtacggtatggacgtctggggccaagggaccacggtcacc

SEQ ID NO: 733 - DNA, 387 bp, Homo sapiens
caggtgcagctggtgcagtctggggctgaggtgaagaagcctggggcctcagtgaaggtctcctgcgagacttctggatacaccttcagcggcttctatttgcactgggtgcgacaggcccctggacaagggcttgagtgggtgggctggatcaacccttacagtggtggcaccgactatgcacagaagtttcagggcagggttaccatgaccctagacacgtccatcagcacagcctacatggaattggacggcctcagatctgacgacacggccattttattattgtgcgagaggatatcaaccccgatcccccgtaattcgatttcttgactgggccgtaggttcgacccctggggccaggggaccctggtcatcgtctcctca

SEQ ID NO: 734 - DNA, 366 bp, Homo sapiens
caggtgcagctggtgcagtctggggctgaggtgaagaagcctggggcctcagtgaaggtctcctgcaaggcttctggatacaccttcaccgacttctatatacgctgggtgcgacaggcccctggacaacgtcttgagtggatgggatggttcaatcctaacactggtggcgcacactctggactggactttcagggcagagtcaccatgaccggggacacgtccatcagcacagcctacatggaactgcccaggctggcatctgacgacacggccatttattactgtgcgagagagggacattgtcgtaccaccagctgccattttgacttctggggccagggagcactggtcaccgtctcctca

SEQ ID NO: 735 - DNA, 364 bp, Homo sapiens
caggtgcagctggtgcagtctggggctgaggtgaggaagcctggggcctctgtgagggtctcctgcaagacttctggatacaccttcaccggctactatatacactgggtgcgacaggcccctggacaagggcttgagtggatgggatggattaatcctgacactggtgccacaaagtattcacagaagtctcagggcagggtctccatgaccagggacacgtccatcagcacagcctacatggaactgaacaggttgatgtctgacgacacggccttctattactgtgcgagacgaccccaagacggcagcagctggtacacgcactggggccagggaacgctggtcaccgtctctacacgcc

SEQ ID NO: 736 - DNA, 366 bp, Homo sapiens
caggtgcagctggtgcagtctggggctgaggtaaagaagcctggggcctcggtgaaggtctcctgcaaggcttctggatacaccttcatcgactactacatatactgggtgcggcaggcccctggacaagggcttgagtggatgggatggatcaaccctaacagaggtggcaccaagtatgcacagaagtttcagggcagggtcaccttgaccagggacacggccgtcaccacggcctatctggaggtgaacagcctgagatctgacgacacggccgtctattattgtgcgagactacaaagccttcatggattttactctaacgctgactactggggccagggaacgctggtcaccgtctcctca

SEQ ID NO: 737 - DNA, 366 bp, Homo sapiens
caggtgcagctggtgcagtctggggctgaggtgaagaagcctgggtcgtcagtgaaggtctcctgcaaggcttctggatacaccttcatcgactactacatatactgggtgcggcaggcccctggacaagggcttgagtggatgggatggatcaaccctaacagaggtggcaccaagtatgcacagaagtttcagggcagggtcaccttgaccagggacacggccgtcaccacggcctatctggaggtgaacagcctgagatctgacgacacggccgtctattattgtgcgagactacaaagccttcatggattttactctaacgctgactactggggccagggaacgctggtcaccgtctcctca

SEQ ID NO: 738 - DNA, 415 bp, Homo sapiens
caggtgcagctggtgcagtctgggcctgaggtgaggaagcctggggcctcagtgaaggtctcctgcgaggcttccggatacaccttcaccggctactatatacactgggtgcgacaggcccctggacaaggccttgagtggatgggatggatcaatcctaacaatgatggcacaacctatgcacacaaatttcagggcagggtcaccgtgaccagggacacgtccattagtacggcctacatggagctgagcggactgagatctgacgacacggccatttattactgtgcgagagcgccatacagcgcactatacttctacatggacgtctggggcaaagggaccacggtcaccgtctcctcagggagcgcatccgccccaacccttttccccctcgtctcctctgagaattccc

SEQ ID NO: 739 - DNA, 380 bp, Homo sapiens
caggtgcagctggtgcagtctggggctgaagtgaagaagcctggggcctcagtgaaggtctcctgcaagacttctggatacagcttcaccggcaactatatacactgggtgcgccaggcccctggacaagggcttgagtggatgggatggatcaaccctaatagtggtggctcaaagtctccacagaagtttcagggcagggtcaccatgaccagggacacgtccgtcagtacagtttacatggaattgaccaggctgaaatttgacgacacggccatatattactgtacgaaagattatggcatgttgggatctactctacccgaatacttccaacactggggccagggcaccctggtcaccgtctcctcacgcctcca

SEQ ID NO: 740 - DNA, 392 bp, Homo sapiens
caggtgcagctggtgcagtctggggctgaagtgaagaagcctggggcctcagtgaaggtctcctgcaaggcttctggatacatcttcaacaactactttttgcactgggtgcgacaggcccctggacaggggcttgagtggatggggtggatcaaccctaacactgctggcacaaactatgcatacaactttcggggcagggtcagcatgaccagggacacgtccaccggaacagcctacatggagctgagcaggctgagatctgacgacacggccgtgtatttctgtgcttcatgcgagcgggtggtagttggtgttacgacgttaggacgggggggtctacgtacgccatggacgtcgtggggccaagggaccacggtcgccgtctcctc

SEQ ID NO: 741 - DNA, 421 bp, Homo sapiens
caggtgcagctggtgcagtctggggctgaagtgaagaatcctggggcctcagtgaaggtctcctgcaagacttctggatacaccttcaccgtccactatattcattgggtacgacaggcccctggacaagggcttgagtggatgggatggatcaaccctaacagtggtgacacggactatgctcagaaatttcagggcagggtcaccatgaccagggacacgcccatcaacgctgcctatttggacttgagtaggctgagatctgacgacacggccgtttattactgtgcaagagatcgatattatgatagtagtggttaccctgatgcttttgatatttggggccaagggacgatggtgaccgtctcttcagggagtgcatccgcccaaccctttcccctcgtctcctctgagaattccc

SEQ ID NO: 742 - DNA, 373 bp, Homo sapiens
caggtgcagctggtgcagtctggggctgaggtgaagaagcctggggcctcagtgatggtctcctgcaaggcttctggatacaccttcatcgactactacatatactgggtgcggcaggcccctggacaagggcttgagtggatgggatggatcaaccctaacagaggtggcaccaagtatgcacagaagtttcagggcagggtcaccttgaccagggacacggccgtcaccacggcctatctggaggtgaacagcctgagatctgacgacacggccgtctattattgtgcgagactacaaagccttcatggattttactctaacgctgactactggggccagggaacgctggtcaccgtctcctcacgcctcc

SEQ ID NO: 743 - DNA, 399 bp, Homo sapiens
caggtgcagctggtgcagtctggggctgaggtgaagaagcctggggcctcagtgaaggtctcctgcaaggcttctggatacagtttcaccacctactctatatactgggtgcgacaggcccctggacaagggcctgagtggatgggatggatcagccctaacagtggtggcacaaactacgcacagaagtttcagggcagggtcaccatgaccagggacacgtccatcaacacagcctacatggacctgaccaggctgacatctgacgacacggccatgtattattgtacggcacggcctataactggaagtgcttttgatatctggggccaagggacaatggtctccgtctcttcagggatgcatcccgcccaacccttttcccctcgtctcctctga

SEQ ID NO: 744 - DNA, 408 bp, Homo sapiens
caggtgcagctggtgcagtctggggctgaggtgaagaagcctggggcctcagtgaaggtctcctgcaaggcttctggatacagtttcaccacctactctatatactgggtgcgacaggcccctggacaagggcctgagtggatgggatggatcaaccctaacagtggtggcacaaactacgcacagaagtttcagggcagggtcaccatgaccggggacacgtccatcaacacggcctacatggacctgaccaggctgacatctgacgacacggccatgtattattgtacggcacggcctataactggaagtgcttttgatatctggggccaagggacaatggtctccgtctcttcagggagtgcatccgccccaacccttttcccctcgtctcctctgagaattccc

SEQ ID NO: 745 - DNA, 366 bp, Homo sapiens
  misc_feature (319)..(319): n is a, c, g, or t
caggtgcagctggtgcagtctggggctgaggtgaagaagcctggggcctcagtgatggtctcctgcaaggcttctggatacaccttcatcgactactacatatactgggtgcggcaggcccctggacaagggcttgagtggatgggatggatcaaccctaacagaggtggcaccaagtatgcacagaagtttcagggcagggtcaccttgaccagggacacggccgtcaccacggcctatctggaggtgaacagcctgagatctgacgacacggccgtctattattgtgcgagactacaaagccttcatggattttacnctaacgctgactactggggccagggaacgctggtcaccgtcgcctca

SEQ ID NO: 746 - DNA, 481 bp, Homo sapiens
caggtgcagctggtgcagtctggggctgaggtgaagaagcctggggcctcagtgatggtctcctgcaaggcttctggatacaccttcatcgactactacatatactgggtgcggcaggcccctggacaagggcttgagtggatgggatggatcaaccctaacagaggtggcaccaagtatgcacagaagtttcagggcagggtcaccttgaccagggacacggccgtcaccacggcctatctggaggtgaacagcctgagatctgacgacacggccgtctattattgtgcgagactacaaagccttcatggattttactctaacgctgactactggggccagggaacgctggtcaccgtctcctcagcctccaccaaggcccatcggtcttccccctggcaccctcctccaagacgcacctctggggcacagcagccctgggctgcctggtcaaggactactcccgaaccggtgacggtgt

SEQ ID NO: 747 - DNA, 345 bp, Homo sapiens
caggtgcagctggtgcagtctggggctgaggtgaagaaacctggggcctcagtgaaggtctcctgccagggttctggatataccttcaccgactactatataaactgggtgcgacaggcccctggacaagggcttgagtggatgggttggatcaactctaacagtggtggcacatcttatgcacagaagtttcagggcagggtcaccatgaccagggacacttccatcagcacagtctacatggaattgagtggactgacatcagacgacacggccgtttattattgtgcgagagtgagtcccccggacgtctggggcaaagggaccacggtcaccgtctcttca

SEQ ID NO: 748 - DNA, 370 bp, Homo sapiens
caggtgcagttggtgcagtctggggctgaggtgaagaagcctggggcctcagtgagggtctcctgcaaggcttctggatacatcttaagcgcctactctatgcactgggtgcgacaggcccctggacaagggcttgagtggatgggatggatcaaggctaacagtgatggcacaaactatgcacagaagtttttcggcagggtcaccatgacccgggacacgtccagcagtacagcctatatggagttgactgggctgagatctgacgacacggccatatattactgtgcgagagcttacgggagttacgcagaatactgcctccactggggccagggcacccttgtcaccgtctcctcacgcctccacc

SEQ ID NO: 749 - DNA, 369 bp, Homo sapiens
caggtgcagctggtgcagtctggggctgaggtgaagaaacctggggcctcagtgaaggtctcctgccagggttctggatataccttcaccgactactatataaactgggtgcgacaggcccctggacaagggcttgagtggatgggttggatcaactctaacagtggtggcacatcttatgcacagaagtttcagggcagggtcaccatgaccagggacacttccatcagcacagtctacatggaattgagtggactgacatcagacgacacggccgtttattattgtgcgagagtgagtcccccggacgtctggggcaaagggccacggtcaccgtctcttcagcctccaccaaggcccatcggtctt

SEQ ID NO: 750 - DNA, 415 bp, Homo sapiens
caggtgcagctggtgcagtctggggctgaggtgaagaagcctggggcctcagtgatggtctcctgcaaggcttctggatacaccttcatcgactactacatatactgggtgcggcaggcccctggacaagggcttgagtggatgggatggatcaaccctaacagaggtggcaccaagtatgcacagaagtttcagggcagggtcaccttgaccagggacacggccgtcaccacggcctatctggaggtgaacagcctgagatctgacgacacggccgtctattattgtgcgagactacaaagccttcatggattttactctaacgctgactactggggccagggaacgctggtcaccgtctcctcagcctccaccaacgggcccatcggtcttccccctggccaccctcctccaa

SEQ ID NO: 751 - DNA, 361 bp, Homo sapiens
caggtgcagctggtgcagtctggggctgaggtgaagaagcctggggcctcagtgaaggtctcctgcaaggcctctggatacaccttcagcggctactactacattcactgggtgcgacaggcccctggacaagggcttgagtggatgggacggatcaatcctaacactggtggcacagactatgcacagaaatttcagggcagggtcaccatgaccagggacacgtccatgaacactctttacttagaattgagcaggctgacatctgacgacacggccgtttattactgtgcgacaattcagcggctggttaaggacttggactactggggccagggaacgcgtggtcaccgtctcctca

SEQ ID NO: 752 - DNA, 363 bp, Homo sapiens
caggtgcagctggtgcagtctgggcctgaggtgaagaagcctggggcctcagtgaaggtctcctgtaaggcttctggatacacctacaatacctactatatgcactgggtgcgacaggcccctggacaagggcttgagtggatgggatggatcaaccctaatagtggtggcacaaactatgcacagagatttcagaccagggtcgacatgaccagggacacgtccataaacacagtctacatggagctgagcggactgacatctgacgacacggccgtgtattattgtgtgactgatttcgaacgggggtataggttttccactacatggacgtcgtggggcaaagggccacggtcatcgtct

SEQ ID NO: 753 - DNA, 353 bp, Homo sapiens
caggtgcagctggtgcagtctggggctgaggtgaagaagcctggggcctcagtgaaggtctcctgcaaggcttctggatacagcttcaccggtcagtatatacactgggtgcgacaggcccctggacaggggcttgagtggatgggaatgataaactgtaacaatggtggcacaaagattgcacagaaatttcagggcagggtcaccctgaccagggacacgtccatcagcacagcctacatggaactgagcagcctgagatctgacgacctggccgtgtatttctgtacgagagccatagtgggttctgagggtgacttctggggccagggaacgctggtcaccgtctcctc

SEQ ID NO: 754 - DNA, 378 bp, Homo sapiens
  misc_feature (311)..(311): n is a, c, g, or t
caggtgcagctggtgcagtctgggcctgaggtgaagaagcctggggcctcagtgaaggtctcctgtaaggcttctggatacacctacaatacctactatatgcactgggtgcgacaggcccctggacaagggcttgagtggatgggatggatcaaccctaatagtggtggcacaaactatgcacagagatttcagaccagggtcgacatgaccagggacacgtccataaacacagtctacatggagctgagcggactgacatctgacgacacggccgtgtattattgtgtgactgatttcaacgggggtanagttttcctttactactttgaccactggggccagggaacgctggtcaccgtctcctcagcctccacc

SEQ ID NO: 755 - DNA, 365 bp, Homo sapiens
caggtgcagctggtgcagtctggggctgagatgaagaagcctggggcctcagtgaaggtctcctgcaagtctactggatactccctcaccggctactatatgcactgggtgcgacaggcccctggacaagggcttgagtggatgggatggatcaaccctaacaatggtgccacaaactatgcacagaagtttcatgacagggtcaccatgacccgggacacgtccatcagtgcagtctacatggagttgaataggctgaagtctgaagacacggccatgttatttttgtgcgagacccatggatgaactccaccactactatttttgactacgtggggtcagggaacgctggtcgccgtctcctc

SEQ ID NO: 756 - DNA, 364 bp, Homo sapiens
caggtgcagctggtgcagtctggggctgaggtgaagaagcctggggcctcagtgaaggtctcctgccaggcttctggatataccatcaccacttatgatttcaactgggtgcgacaggcccctggacaagggcttgagtggatgggatggatcaaccctcacagtggtggcacaaactatgcacagcactttcagggcagggtcaccatgaccagggacacgtccatcaacacagtctacatggacctgagcaggctgacatctgacgacacggtccttttattctgtgcgagagataataattgggaccgaagatgacaactggttcgaccctggggccagggaaccctggtcaccgtctcct

SEQ ID NO: 757 - DNA, 357 bp, Homo sapiens
caggtgcagctggtgcagtctggggctgaggtgaagaagcctggggcctcagtgaaggtctcctgcaaggcttctggatacatcttcgccggctactatatggagtgggtgcggcagacccctggacaagggcttgagtggatgggatggatcgaccctagaagtggtggcacaaattatgctcagaagtttcagggcagggtcaccctgaccagggacacgtccctccggacagcctatatggagttgagcagcctcagatctgacgacacggccgtctattattgtgcgacagataacggcagcggtatcttctggggcaagggaacggtggtcaccgtctccgcagcctccacc

SEQ ID NO: 758 - DNA, 380 bp, Homo sapiens
caggtgcagctggtgcagtctggggctgaggtgaagaagcctggggcctcagtgaaggtctcctgcaaggcctctggatacagtttcagcgactaccatatacactgggtgcgacaggcccctggacaagggcttgagtggatgggatggatcaaccagaatgggtggtggcgcaacgacatgtacagaagttccagggcagggtcgccatgaccaggggacacgtccatcagcacagcctttatggagctgagcaggctgagatttgacgacacggccatatattattgtgcgagagattattacgatgttttgactacttattctcattacttctttgacttatggggccagggaacgctggtcaccgtcatacgtgg

SEQ ID NO: 759 - DNA, 369 bp, Homo sapiens
caggtgcagctggtgcagtctggggcagaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaaatttcaggacagagtcacatttaccacggacgaatcgaagactacagcctacatggagttgagcagcctgagatctgaggattcggccgtctattactgtgcgataaataccgactcagtggctacctctttgtacagtttgggcgtctggggccaagggaccacggtcaccgtctcctca

SEQ ID NO: 760 - protein, 121 aa, Homo sapiens
QVQLVQSGAVIKTPGSSVKISCRASGYNFRDYSIHWVRLIPDKGFEWIGWIKPLWGAVSYARQLQGRVSMTRQLSQDPDDPDVGVAYMEFSGLTPADTAEYFCVRRGSCDYCGDFPWQYWG

SEQ ID NO: 761 - protein, 147 aa, Homo sapiens
QVQLVQSGAVIKTPGSSVKISCRASGYNFRDYSIHWVRLIPDKGFVWIGWIKPLWGAVSYARQLQGRVSMTRQLSQDPDDPDWGVAYMEFSGLTPADTAEYFCVRRGSCDYCGDFPWQYWGQGTVVVVSSASTKAHRSSPGHPPPRR

SEQ ID NO: 762 - protein, 144 aa, Homo sapiens
QVQLVQSGAVIKTPGSSVKISCRASGYNFRDYSIHWVRLIPDKGFEWIGWIKPLWGAVSYARQLQGRVSMTRQLSQDPDDPDWGVAYMEFSGLTPADTAEYFVRRGSCDYCGDFPWQYWGQGTVVVVSSAPTKAHRSSPWPPSS

SEQ ID NO: 763 - protein, 130 aa, Homo sapiens
QVQLVQSGAVIKTPGSSVKISCRASGYNFRDYSIHWVRLIPDKGFEWIGWIKPLCGAVSYARQLQGRVSMTRQLSQDPDDPDWGVAYMEFSGLTPADTAEYFVSGEGPVIIAETFPGNTWGQGTVVVVSS

SEQ ID NO: 764 - protein, 133 aa, Homo sapiens
QVQLVQSGAVIKTPGSSVKISCRASGYNFRDYSIHWVRLIPDKGFEWIGWIKPLWGAVSYARQLQGRVSMTRQLSQDPDDPDWGVAYMEFSGLTPADTAEYFCVRRGSCDYCGDFPWQYWGQGTVVVVSSAST

SEQ ID NO: 765 - protein, 133 aa, Homo sapiens; identical to SEQ ID NO: 764

SEQ ID NO: 766 - protein, 133 aa, Homo sapiens; identical to SEQ ID NO: 764

SEQ ID NO: 767 - protein, 126 aa, Homo sapiens
QVQLVQSDADLRKPGASVKVSCKASGYIFKNQYIHWVRQAPGRGFEWMGHLNPWSGGTVYAQKFQDRLSMTRDMSTSTAYMELRSLTSDDTANYFCLTAIIDVVYWGQGTVVTVSSASTKGPSVFP

SEQ ID NO: 768 - protein, 122 aa, Homo sapiens
QVQLVQSGTEVKKSGASLKISCMTAGYTFSAHYIHWVRQAPGQGLEWMGWINPATGDTKFVQTFQGRLAMTRDTTTDTVNLILASVKPNDTATYYCARDWQFQVTFGDFYMDIWGNGTTVIV

SEQ ID NO: 769 - protein, 133 aa, Homo sapiens
QVQLVQSDADLRNPGASVKVSCKASGYIFKNQYIHWVRQAPGQGFEWMGHLNPWSGGTVYAQKFQDRLSMTRDMSTSTAYMELRSLTSDDTANYFCSLQLVSSTWGQGTVVTVSSASTKGPSVLPLGHPPPTT

SEQ ID NO: 770 - protein, 115 aa, Homo sapiens
QVQLVQSDADLRNPGASVKVSCKASGYIFKNQYIHWVRQAPGQGFEWMGHLNPWSGGTVYAQKFQDRLSMTRDMSTSTAYMELRSLTSDDTANLLLLTAILVSSTWGQGTWSPSP

SEQ ID NO: 771 - protein, 131 aa, Homo sapiens
QVQLVQSGADVKKPGTSVKVSCKASGDAFSDYYLHWVRQVPGQGLEWMGWMDPNNGATNYAPKFQGMIIMTRDTSINTVYLELRRLRSDDTAVYFCTRDASGPQTYYYDSSGFEFDSWGQGTLVIVSSAST

SEQ ID NO: 772 - protein, 122 aa, Homo sapiens
QVQLVQSGTEMKKSGASLKVSCKTSGYTFSAHYIHWVRQAPGQGLEWMGWINPDSGATKFGQAFQGRISMTRDTSTDTVNLLLVNLRPNDTATYYCARDWQFQVTFGDFYMDIWGNGTTVIV

SEQ ID NO: 773 - protein, 127 aa, Homo sapiens
QVQLVQSGTEMKKSGASLKVSCKTSGYTFSAHYIHWVRQAPGQGLEWMGWINPDSGDTNFAQTFQGRTTLTRDAFANTVNLLLASLKPNDTATYYCARDWQFQGTFGDFYMDIWGNGTTVIVSPAST

SEQ ID NO: 774 - protein, 145 aa, Homo sapiens
QVQLVSGTEMKKSGASLKVSCKTSGYTFSAHYIHWVRQAPGQGLEWMGWINPDSGDTNFAQTFQGRTTLTRDAFANTVNLLLASLKPNDTATYYCARDWQFQGTFGDFYMDIWGNGTTVIVSQPPPGPSVFPWPPSSKTHLVGAR

SEQ ID NO: 775 - protein, 130 aa, Homo sapiens
QVQLVQSGTEMKKSGASLKVSCKTSGYTFSAHYIHWVRQAPGQGLEWMGWINPDSGDTNFAQTFQGRTTLTRDAFANTVNLLLASLKPNDTATYYCARDWQFQGTFGDFYMDIWGNGTTVIVSPASTNGP

SEQ ID NO: 776 - protein, 122 aa, Homo sapiens
QVQLVQSGTEMKKSGASLKVSCKTSGYTFSAHYIHWVRQAPGQGLEWMGWINPDSGDTNFAQTFQGRTTLTRDAFANTVNLLLASLKPNDTATYYCARDWQFQVTFGDFYMDIWGNGTTVIV

SEQ ID NO: 777 - protein, 153 aa, Homo sapiens
QVQLVQSGTEMKKSGASLKVSCKTSGYTFSAHYIHWVRQAPGQGLEWMGWINPDSGDTHFAQTFQVRTTLTRDPFTGTVILLLASLRPNDTATYYCARDWQFQGTFGDFYMDIWGNGTTVIVSPASTRAHRSSPGTLLQDAPLGHSGPGCLVR

SEQ ID NO: 778 - protein, 152 aa, Homo sapiens
QVQLVQSGTEMKKSGASVKVSCETSGYTFTAYYIHWVRQAPGRGLEWMGWINPDSGDTKFARTFQGRTTVTRDTSTNTVNLLLASLQSNDTATYYCARDWQFQVTFGDYYMDIWGNGTTVIVSPASTKAHRSSPGTLLQDAPLGHSGLGCLV

SEQ ID NO: 779 - protein, 144 aa, Homo sapiens
QVQLVQSGTKMMKSGASMKVPCKTSGYTFTAYYIHWVRQAPGRGLEWMGWINPDSGDTNFAQTFKDRVNMTRDTSTTTVNLVLVNLRSDDTATYYCARDWQYQVIFGDFYLDIWGNGTTVIVVSSLHQGPSVFPLATLLQRRHL

SEQ ID NO: 780 - protein, 120 aa, Homo sapiens
QVQLVQSGAEVKKTGASVRVSCETSGYPFTNHYIHWVRQAPGHGLEWMAWINPSGGATIYAEAFEGRIMVSSDTSLNTVYMELESLTSGDTAMYFCARDATPITTEFDFWGQGTLITVSS

SEQ ID NO: 781 - protein, 120 aa, Homo sapiens; identical to SEQ ID NO: 780

SEQ ID NO: 782 - protein, 120 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTPVTVSS

SEQ ID NO: 783 - protein, 139 aa, Homo sapiens
QVQLVQSGAEVKKTGASVRVSCETSGYPFTNHYIHWVRQAPGHGLEWMAWINPSGGATIYAEAFEGRIMVSSDTSLNTVYMELESLTSGDTAMYFCARDATPITTEFDFWGQGHSPSPQPPPRPIGPSPSATLLQRRHL

SEQ ID NO: 784 - protein, 123 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTPVTVSSRLH

SEQ ID NO: 785 - protein, 142 aa, Homo sapiens
QVQLVQSGTEVKKSGASVKVSCQTSGYTFSAYYIHWVRQAPGRGLEWLGWINPDNGDTKFAQNFHGRSTVTRDTSTSTVNLLLTSLQPNDTATYYCARDWQFQVIFGDYYMDIWGNGTTVIVSPASTKAHRSPPGHPPPTTH

SEQ ID NO: 786 - protein, 124 aa, Homo sapiens
QVQLVQSGTEVKKSGASVKVSCQTSGYTFSAYYIHWVRQAPGRGLEWLGWINPDNGDTKFAQNFHGRSTVTRDTSTSTVNLLLTSLQPNDTATYYCARDWQFQVIFGDYYMDIWGNGTTVIVSS

SEQ ID NO: 787 - protein, 120 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTAGHRLLT

SEQ ID NO: 788 - protein, 127 aa, Homo sapiens
QVQLVQSGTEMKKSGASMKVSCKTSGYTFTGYYIHWVRQAPGRGLEWMGWINPNNGDTNFAQSFKDRVSMTRDTSTTTVNLVLANLRNDDTATYYCARDWQYQVIFGDFYLDIWGNGTTIIVSPAST

SEQ ID NO: 789 - protein, 115 aa, Homo sapiens
QVQLVQSGAEVKKPGASVKVSCQASGYGFTDQHLNWIRQAPGQGFEWLGRFNPANGGTDLAQKFQGRVSMTRNMSITTAYLELSRLTSDDTATYYCLNSGRMNITMTTWGQGTAG

SEQ ID NO: 790 - protein, 122 aa, Homo sapiens
QVQLVQSGAEVKKPGAPVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTPVTVSSRLH

SEQ ID NO: 791 - protein, 118 aa, Homo sapiens
QVQLVQSGAEVKKPGASVKASCQASGYRFTDQHLNWIRQAPGQGFEWLGRFNPANGGTDLAQKFQGRVSMTRNMSITTAYLELSRLTSDDTATYYCLNSGRMNITMTTWGQGTPVTVS

SEQ ID NO: 792 - protein, 120 aa, Homo sapiens
QVQLVQSGAEVKKPGASVKVSCQASGYRFTDQHLNWIRQAPGQGFEWLGRFNPANGGTDLAQKFQGRLSMTRNMSITTAYLELSRLTSDDTATYYCLNSGRMNITMTTWGQGTPVTVSSR

SEQ ID NO: 793 - protein, 117 aa, Homo sapiens
QVQLVQSGAEVKKPGASVKVSCQASGYRFTDQHLNWIRQAPGQGFEAGQVQPCQWRHRSCTEVSGVSMTRNMSITTAYLELSRLTSDDTATYYCLNSGRMNITMTTWGQGTPVTVSS

SEQ ID NO: 794 - protein, 121 aa, Homo sapiens
QVQLVQSGAEVKKPGASVKVSCQASGYRFADQHLNWIRQAPGQGFEWLGRFNPANGGTDLAQKFQGRVSMTRNMSITTAYLELSRLTSDDTATYYCLNSGRMNITMTTWGQGTAGHRLLTP

SEQ ID NO: 795 - protein, 122 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTAGHRLLTPP

SEQ ID NO: 796 - protein, 123 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTAGHRLLTPPP

SEQ ID NO: 797 - protein, 125 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTPVTVSSRLHQRP

SEQ ID NO: 798 - protein, 121 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTAGHRLLTP

SEQ ID NO: 799 - protein, 122 aa, Homo sapiens
QVQLVQSGAEVKKPGASVKVSCQASGYRFTDQHFELDTTGPWTRVVAGQVQPCQWRHRSCTEVSGVSMTRNMSITTAYLELSRLTSDDTATYYCLNSGRRMNITMTTWGQGTAGHRLLTPPP

SEQ ID NO: 800 - protein, 119 aa, Homo sapiens
QVQLVQSGAEVKKPGASVKVSCQASGYRFTDQHFELDTTGPWTRVVAGQVQPCQWRHRSCTEVSGVSMTRNMSITTAYLELSRLTSDDTATYYCLNSGRMNITMTTWGQGTAGHRLLTP

SEQ ID NO: 801 - protein, 126 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTPVTVSSRLHQRA

SEQ ID NO: 802 - protein, 125 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTPVTVSSRLHQR

SEQ ID NO: 803 - protein, 121 aa, Homo sapiens; identical to SEQ ID NO: 798

SEQ ID NO: 804 - protein, 134 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTAGHRLLTPPPTAHVRSFPRRP

SEQ ID NO: 805 - protein, 120 aa, Homo sapiens
QVQLVQSGAEVKKPGASVKVSCQASGYRFTDQHFELDTTGPWTRVVAGQVQPCQWRHRSCTEVSGVSMTRNMSITTAYLELSRLTSDDTATYYCLNSGRMNITMTTWGQGTPVTVSSRLH

SEQ ID NO: 806 - protein, 123 aa, Homo sapiens; identical to SEQ ID NO: 796

SEQ ID NO: 807 - protein, 123 aa, Homo sapiens
QVQLVQSGAEVKKPGASVKVSCQASGYRFTDQHLNWIRQAPGQGFEWLGRFNPANGGTDLAQKFRGRVSMTRNMSITTAYLELSRLTSDDTATYYCLNSGWTNEYHYDHWGQGTPVTVSSRLH

SEQ ID NO: 808 - protein, 121 aa, Homo sapiens; identical to SEQ ID NO: 798

SEQ ID NO: 809 - protein, 121 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTPVTVSSRL

SEQ ID NO: 810 - protein, 114 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGT

SEQ ID NO: 811 - protein, 120 aa, Homo sapiens; identical to SEQ ID NO: 782

SEQ ID NO: 812 - protein, 121 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTAGHRLLT

SEQ ID NO: 813 - protein, 115 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTPV

SEQ ID NO: 814 - protein, 119 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTAGHRLL

SEQ ID NO: 815 - protein, 124 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTPVTVSSRLHQ

SEQ ID NO: 816 - protein, 135 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTAGHRLLTPPPTAHPVLPPSAT

SEQ ID NO: 817 - protein, 122 aa, Homo sapiens; identical to SEQ ID NO: 795

SEQ ID NO: 818 - protein, 121 aa, Homo sapiens
QVQLVSRGLKRSLGPQRSPVRLLDTDSPTNIIGYDRPPGQGFEWLGRFNPANGGTDLAQKFQGRVSMTRNMSITTAYLELSRLTSDDTATYYCLNSGWTNEYHYDHWGQGTPVTVSSRLHQ

SEQ ID NO: 819 - protein, 121 aa, Homo sapiens; identical to SEQ ID NO: 798

SEQ ID NO: 820 - protein, 118 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTPVTVS

SEQ ID NO: 821 - protein, 120 aa, Homo sapiens
QVQLVQSGAEVKKPGASVKVSCQASGYRFTDQHLNWIRQAPGQGFEWLGRFNPANGGTDLAQKFQGRVSMTGNMSITTAYLELSRLTSDDTATYYCLNSGRMNITMTTWGQGTAGHRLLT

SEQ ID NO: 822 - protein, 135 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTPVTVSSRLHQRAHVRSFPRRPP

SEQ ID NO: 823 - protein, 115 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTAG

SEQ ID NO: 824 - protein, 123 aa, Homo sapiens; identical to SEQ ID NO: 796

SEQ ID NO: 825 - protein, 119 aa, Homo sapiens
QVQLVQSGAEVKKPGASVKVSCQASGYRFTDQHLDWIRQAPGQGFEWLGRFNPANGGTDLAQKFQGRVSMTRNMSITTAYLELSRLTSDDTATYYCLNSGRMNITMTTWGQGTAGHRLL

SEQ ID NO: 826 - protein, 119 aa, Homo sapiens; identical to SEQ ID NO: 814

SEQ ID NO: 827 - protein, 118 aa, Homo sapiens
QVQLVQSGAEVKKPGASVKVSCQASGYRFTDQHLNWIRQAPGQGFEWLGRFNPANGGTDLAQKVSGGQYDQKHVHHHSVFGTEQADIRHGHLLLSEFWLTNEYHYDHWGQGTPVTVSS

SEQ ID NO: 828 - protein, 123 aa, Homo sapiens; identical to SEQ ID NO: 784

SEQ ID NO: 829 - protein, 135 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTPVTVSSRLHQRPIRSFPRRPP

SEQ ID NO: 830 - protein, 118 aa, Homo sapiens
QVQLVQSGAEVKKPGASVKVSCQASGYRFTDQHLNWIRQAPGQGFEWLGRFNPCQWRHRSCTEVSGGQYDQKHVHHHSVFGTEQADIRHGHLLLSEFWLTNEYHYDHWGQGTAGHRLL

SEQ ID NO: 831 - protein, 121 aa, Homo sapiens; identical to SEQ ID NO: 798

SEQ ID NO: 832 - protein, 123 aa, Homo sapiens; identical to SEQ ID NO: 796

SEQ ID NO: 833 - protein, 119 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTPVTVSS

SEQ ID NO: 834 - protein, 122 aa, Homo sapiens; identical to SEQ ID NO: 795

SEQ ID NO: 835 - protein, 118 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTAGHRP

SEQ ID NO: 836 - protein, 140 aa, Homo sapiens
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGRMNITMTTWGQGTPVTVSSRLHQRAHSGPSPSATRPPTTP

SEQ ID NO: 837 - protein, 148 aa, Homo sapiens
QVQLVQSGAEVKKPGASVKVSCKATGYRFTDYHLIWIRQAPGQGFEWVGRFNPANGVTNLAQKFQDRVSMTRNTSITTAYLELSRLTPDDTATYYCVNSGWDIDYHYDHWGQGTLVIVSSASTKAHRSSPWHPPPRAPLGHSSPGCLV

SEQ ID NO: 838 - protein, 126 aa, Homo sapiens
QVQLVQSGAEVKKPGASVKVSCKATGYRFTDYHLIWIRQAPGQGFEWVGRFNPANGVTNLAQKFQDRVSMTRNTSITTAYLELSRLTPDDTATYYCVNSGWDIDYHYDHWGQGTLVIVSSASTNGP

SEQ ID NO: 839 - protein, 150 aa, Homo sapiens
QVQLVQSGAEVKKPGASVKASCGTSGYTFANYYIHWLRQAPGQGLEWMAWINPGSGSTIYSENFEGRVTVTSDTSMQTVYMDLDSLTSRDTAVYYCARDATPPTTEFDHWGQGTLITVSSASTKGPSVFPLAPSSKSTSGAQRPWAAWSR

SEQ ID NO: 840 - protein, 141 aa, Homo sapiens
QVQLVQSGAEVKMLGASVKVSCQASGHKFTNYYIHWVRQAPGQGLEWMGWINPQNGDNNFGMRFQDRVTTTSDRSTRTVYLELSGLTPDDTAMYFCTRFLKPVEYYDRSGPQFGYWGQGTLVSVSSASTRPIGLPPGHPPP

SEQ ID NO: 841 - protein, 123 aa, Homo sapiens
QVQLVQSGAEVKKPGASVKVSCKATGYRFTDYHLIWIRQAPGQGFEWVGRFNPANGVTNLAQKFQDRVSMTRNTSITTAYLELSRLTPDDTATYYCVNSGWDIDYHYDHWGQGTLVIVSSAST

SEQ ID NO: 842 - protein, 134 aa, Homo sapiens
QVQLVQSGAEVKKPGASVKVSCGTSGYTFANYYIHWLRQAPGQGLEWMAWINPGSGSTIYSENFEGRVTVTSDTSMQTVYMDLDSLTSRDTAVYYCARDATPPTTEFDHWGQGTLITVSSASTNGPSGPSPSAT

SEQ ID NO: 843 - protein, 123 aa, Homo sapiens
QVQLVQSGAEVKKPGASVKVSCGTSGYTFANYYIHWLRQAPGQGLEWMAWINPGSGSTIYSENFEGRVTVTSDTSMQTVYMDLDSLTSRDTAVYYCARDATPPTTEFDHWGQGTLITVSSAST

SEQ ID NO: 844 - protein, 120 aa, Homo sapiens
QVQLVQSGAEVKKPGASVKVSCGTSGYTFANYYIHWLRQAPGQGLEWMAWINPGSGSTIYSENFEGRVTVTSDTSMQTVYMDLDSLTSRDTAVYYCARDATPPTTEFDHWGQGTLINRVL

SEQ ID NO: 845 - protein, 129 aa, Homo sapiens
QVQLVQSGAEVKKPGASVKVSCQASGHKFTNYYIHWVRQAPGQGLEWMGWINPQNGDNNFGMRFQDRVTTTSDRSTRTVYLELSGLTPDDTAMYFCTRFLKPVEYYDRSGPQFGYWGQGTLVSVSSAST

SEQ ID NO: 846 - protein, 120 aa, Homo sapiens
QVQLVQSGAEVKKPGASVKVSCGTSGYTFANYYIHWLRQAPGQGLEWMAWINPGSGSTIYSENFEGRVTVTSDTSMQTVYMDLDSLTSRDTAVYYCARDATPPTTEFDHWGQGTLITVSS

SEQ ID NO: 847 - protein, 125 aa, Homo sapiens
QVQLVQSGAQVLKPGASVKLSCKTSGYTFSDFYTHWVRQVPGRRLEWMGWFNPNSGGAHYGLDFQGRVTSAGDTSITTVYMELTRLAFDDTAIYYCAREAHCGTTSCQFDSWGQGTLVTVSSAST

SEQ ID NO: 848 - protein, 114 aa, Homo sapiens
QVQLVQFGADVEKPGASVRVSCKASGYDFINYYIHVRQAPGQGLEWMAWINPSGGATIYAESFEGRVTVTRDTSMSTVYMELESLTSGDTAMYYCARDATPITTEFVYWGQGTL

SEQ ID NO: 849 - protein, 122 aa, Homo sapiens
QVQLVQSGAEVKKPGSSVKVSCKASGGTFSSSAVNWVRQAPGKRLEWVGWFNPKTGGAHYGLDYQGRVTMTGDTSITTVYMELTRLASDDTAMYYCAREGVCRTTSCQFDFWGQGTLVTVFS

SEQ ID NO: 850 - protein, 117 aa, Homo sapiens
QVQLVQFGADVEKPGASVRVSCKASGYDFINYYIHWVRQAPGQGLEWMGCINPRTGDTKYAQRFQDEVSMTRDTSISTVYMELREMTYDDTAIYFCLTAIDGVSYWGLGKLVTVASA

SEQ ID NO: 851 - protein, 115 aa, Homo sapiens
QVQLVQFGADVEKPGASVRVSCKASGYDFINYYIHWVRQAPGQGLEWMGCINPRTGDTKYAQRFQDKVSMTRDTSISTVYMELREMTYDDTAIYFVSLQTVSPVWGLGKLVTVAS

SEQ ID NO: 852 - protein, 120 aa, Homo sapiens; identical to SEQ ID NO: 846

SEQ ID NO: 853 - protein, 120 aa, Homo sapiens
QVQLVQSGAEMMKPGASLKVSCQTSGYNFNGHFLHWVRQAPGQGLEWMARINPSSGVTDFAQKFQDRVTVTRDSLRQLQSTIGITAAIHGRVLLCERWDHFDLVFLTWGQGTRGHRLLSP

SEQ ID NO: 854 - protein, 119 aa, Homo sapiens
QVQLVQFGADVEKPGASVRVSCKASGYDFINYYIHWVRQAPGQGLEWMGCINPRTGDTKYAQRFQDKVSMTRDTSISTVYMELREMTYDDTAIYFCLTAIDGVSYWGLGKLVTVASAST

SEQ ID NO: 855 - protein, 120 aa, Homo sapiens
QVQLVQSDADLRNPGASVKVSCKASGYIFKNQYIHWVRQAPGQGFEWMGHLNPWSGGTVYAQKFQDRLSMTRDMSTSTAYMELSRLRFDDTAVYYCARDPQEVSGWYTHWGQGTLVTVSS

SEQ ID NO: 856 - protein, 119 aa, Homo sapiens
QVQLVQSGAEMMKPGASLKVSCQTSGYNFNGHFLHWVRQAPGQGLEWMARINPSSGVTDFAQKFQDRVTVTRDISTTTIYMELHRLRSDDTAVYYCARDGIISTGLFDWGQGTLVTVSS

SEQ ID NO: 857 - protein, 137 aa, Homo sapiens
QVQLVQSGAGVRKPGSSVMVSCKASGDTFNNYYIHWVRQAPGHGTKWMAWINPSGGATIYAEAFEGRVTVTTDTSMKTVYMELESLTSGDTAMYFCARDATPITTEFDYWGQGTLITVSSASTNGPLGPSPSATLLQ

SEQ ID NO: 858 - protein, 117 aa, Homo sapiens
QVQLVQFGADVEKPGASVRVSCKASGYDFINYYIHWVRQAPGQGLEWMGCINPRTGDTKYAQRFQDKVSMTRDTSISTVYMELREMTYDDTAIYFCLTAIDGVSYWGLGKLVTVASA

SEQ ID NO: 859 - protein, 174 aa, Homo sapiens
QVQLVQSGAEVKKPGASMKVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKGPSVFPWHPPPRAPLGAQRPWAAWSRTTSRTGDGVVELRRPDQRRAHLP

SEQ ID NO: 860 - protein, 122 aa, Homo sapiens
QVQLVQSGAEMMKPGASLKVSCQTSGYNFNGHFLHWVRQAPGQGLEWMARINPSSGVTDFAQKFQDRVTVTRDISTTTIYMELHRLRSDDTAVYYCARDGIISTGLFDWGQGTLVTVSSAST

SEQ ID NO: 861 - protein, 132 aa, Homo sapiens
QVQLVQSGSQMKKSGASLNVSCQTSGYTFSDYYLHWVRRAPGQGLQWMGWINPENGDTNYAQTFKGRVTMTRDTAINTAYMVLTGLKFNDTAMYYCARDWQFHVIFDDYYIDVWGTGTTVIVSSASTKGPSV

SEQ ID NO: 862 - protein, 122 aa, Homo sapiens
QVQLVQSGAQVLKPGASVKLSCKTSGYTFSDFYIHWVRQVPGRRLEWMGWFNPNSGGAHYGLDFQGRVTSAGDTSITTVYMELTRLAFDDTAIYYCAREAHCGTTSCQFDSWGQGTLVTVSS

SEQ ID NO: 863 - protein, 123 aa, Homo sapiens
QVQLVQSGAQVLKPGASVKLSCKTSGYTFSDFYIHWVRQVPGRRLEWMGWFNPNSGGAHYGLDFQGRVTSAGDTSITTVYMELTRLAFDDTAIYYCAREAHCGTTSCQFDSWGQGTRGHRLLT

SEQ ID NO: 864 - protein, 129 aa, Homo sapiens
QVQLVQSGAEVRKPGASVKVSCVASGYTLSDHFLHWVRRAPGHGLEWLGWTNPQNGFTNFAQDFQDRVTMTSDTSTGTAYMELNRLTSADTAIYYCARGAHRHSDRSGYYSEIDAWGQGTLVTVSSRLH

SEQ ID NO: 865 - protein, 137 aa, Homo sapiens
QVQLVQPGAEVKKPASSVKVSCQASRYTFTKYFTQWVRQGPGQGHEWLGCINPYNDNTHYAQKFWGRVTITSDRSVSTAYMELSSLRSEDMVVYSCVPWGNPTGDYYYYYYMDVWGKGTTVTVSSGCIRPTLSPRLL

SEQ ID NO: 866 - protein, 136 aa, Homo sapiens
QVQLVQSGAKIGKPGASVQVSCKASEYTFTDFYIHWVRQTPGQGLEWMGWINANTGATEFAQKFLGRIIMTRDTSINTVYMELSRLIFNDTAIYYCASAYASSGEFLYWGQGSRVTVSSGSASAPTLFPSSPLRIP

SEQ ID NO: 867 - protein, 118 aa, Homo sapiens
QVQLVQSGAEVKKPGASVKVSCGTSGYTFANYYIHWLRQAPGQGLEWMAWINPSGGSTIYSENFEGRVTVTRDTSMKTVYMELDSLTSGDTAVYYCARDATPVTTEFDYWGQGTLITV

SEQ ID NO: 868 - protein, 136 aa, Homo sapiens
QVQLVQSGAEIGKPGASVQVSCKASEYTFTDFYIHWVRQTPGQGLEWMGWINANTGATEFAQKFLGRIIMTRDTSINTVYMELSRLIFNDTAIYYCASAYASSGEFLYWGQGSRVTVSSGSASAPTLFPSSPLRIP

SEQ ID NO: 869 - protein, 123 aa, Homo sapiens
QVQLVQSGAEVKKPGASVKVSCGTSGYTFANYYIHWLRQAPGQGLEWMAWINPSGGSTIYSENFEGRVTVTRDTSMKTVYMELDSLTSGDTAVYYCARDATPVTTEFDYWGQGTLITVSSAST

SEQ ID NO: 870 - protein, 122 aa, Homo sapiens
QVQLVQSGAEVKKPGASVKVSCGTSGYTFANYYIHWLRQAPGQGLEWMAWINPSGGSTIYSENFEGRVTVTRDTSMKTVYMELDSLTSGDTAVYYCARDATPVTTEFDYWGQGTLITVSSRL

SEQ ID NO: 871 - protein, 121 aa, Homo sapiens
QVQLVQSGAEVKKPGASVKVSCGTSGYTFANYYIHWLRQAPGQGLEWMAWINPSGGSTIYSENFEGRVTVTRDTSMKTVYMELDSLTSGDTAVYYCARDATPVTTEFDYWGQGTLITVSSR

SEQ ID NO: 872 - protein, 120 aa, Homo sapiens
QVQLVQSGAEVKKPGASVKVSCGTSGYTFANYYIHWVRQAPGHGLEWMAWINPSGGSTIYAESFEGRVTVTADTSMKTVYMELESLTSGDTAMYFCARDATPMTTEFDYWGQGTLITVSS

SEQ ID NO: 873 - protein, 133 aa, Homo sapiens
QVQLVQSGAEVKKPGASVKVSCKASGYTFTDYFVHWVRQAPGQNFEWMGWTNVNTGGTKYAPKFQGRVTITADIPTNTAYLELSSLRSDDAAVYYCARGSILDMSTASSYYYVMDVWGQGTTVTVSSASTKGP

SEQ ID NO: 874 - protein, 120 aa, Homo sapiens
QVQLVQSGAEVKKPGASVKVSCGTSGYTFANYYIHWLRQAPGQGLEWMAWINPSGGSTIYSENFEGRVTVTRDTSMKTVYMELDSLTSGDTAVYYCARDATPVTTEFDYWGQGTLITVSS

SEQ ID NO: 875 - protein, 122 aa, Homo sapiens
QVQLVQSGAEVKKPGTSVKVSCKAFGYAFSDYYLHWVRQVPGQGLEWMGWMDPNNGATNYAPKFQGMIIMTRDTSHQYSLFGVEEAEIRRHGRLFLYGRCRRAPDVLLQWFEFDSWGQGTLV

SEQ ID NO: 876 - protein, 124 aa, Homo sapiens
QVQLVQSGSEVKKSGASVSVSCKASGYSFTDYYLHWVRQAPGQGLQWMGWINPESGDTNYARAFRGRITMTRDTSINTAYMMLTGLRSNDTAVYFCARDWQFHVIFDDYYIDAWGKGTTVIVSS

SEQ ID NO: 877 - protein, 122 aa, Homo sapiens
QVQLVQSGTDARKPGASVKVSCKASGYSFTDYYIHWVRQAPGKRLEWVGWFNPKTGGAHYGLDYQGRVTMTGDTSITTVYMELTRLASDDTAMYYCAREGVCRTTSCQFDFWGQGTLVTVSS

SEQ ID NO: 878 - protein, 121 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVHRLL

SEQ ID NO: 879 - protein, 139 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSGSASAPTLFPLVLLRTSHT

SEQ ID NO: 880 - protein, 141 aa, Homo sapiens
QVQLVPSGAEVKKPGASMRVSCQTSGYTFNSYYIHWMRQVPGQGLEWMGWINPNSGYTNYTQKFQDRVTMTRDTSINTAYLELSALRSDETAVYYCARDFSDGWPYSFDFWGQGTLVTVSSRLHQRAHRSFPLATLLQRRH

SEQ ID NO: 881 - protein, 122 aa, Homo sapiens
QVQLVQSGTDARKPGASVKVSCKASGYSFTDYYIHWVRQAPGKRLEWVGWFNPKTGGAHYGLDYQGRVTMTGDTSITTVYMELTRLASDDTAMYYCAREGVCRTTSCQFDFWGQGTLVTVFS

SEQ ID NO: 882 - protein, 117 aa, Homo sapiens
QVQLVQSGTDARKPGASVKVSCKASGYSFTDYYIHWVRQAPGKRLEWVGWFNPKTGGAHYGLDYQGRVTMTGDTSITTVYMELTRLASDDTAMYYCAREGVELPAANLTSWGQGTRG

SEQ ID NO: 883 - protein, 135 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTKAHRSSPWPPSS

SEQ ID NO: 884 - protein, 122 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRL

SEQ ID NO: 885 - protein, 125 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTATYFCARDATPITTEFDYWGQGTLITVSSASTNG

SEQ ID NO: 886 - protein, 140 aa, Homo sapiens
QVQLVQSGTDARKPGASVKVSCKASGYSFTDYYIHWVRQAPGKRLEWVGWFNPKTGGAHYGLDYQGRVTMTGDTSITTVYMELTRLASDDTAMYYCAREGVCRTTSCQFDFWGQGTLVTVFSASTNGPIRSSPWPPSSND

SEQ ID NO: 887 - protein, 122 aa, Homo sapiens
QVQLVQSGAEVKKPGTSVKVSCKAFGYAFSDYYLHWVRQVPGQGLEWMGWMDPNNGATNYAPKFQGMIIMTRDTSINTVYMELRRLRSDDTAVYFCTRDAGGPQTYYYDSSGLNLTPWGQGT

SEQ ID NO: 888 - protein, 134 aa, Homo sapiens
QVQLVQSGAEVRKPGASVKVSCGTSGYTFANYYIHWVRQAPGHGLEWMAWINPSGGATIYAEAFEGRVTVTTDTSMKTVYMELESLTSGDTAMYFCARDATPITTEFDYWGQGTLITVSSRLHQRAHSGPSPSA

SEQ ID NO: 889 - protein, 120 aa, Homo sapiens
QVQLVQSGTDARKPGASVKVSCKASGYSFTDYYIHWVRQAPGKRLEWWGGSILRLVARTMDWTIRAERPGDTSITTVYMELTRLASDDTAMYYCAREGVCRTTSCQFDFWGQGTLVTVFS

SEQ ID NO: 890 - protein, 128 aa, Homo sapiens
QVQLVQSGAEVKKPGTSVKVSCKAFGYAFSDYYLHWVRQVPGQGLEWMGWMDPNNGATNYAPKFQGMIIMTRDTSINTVYLELRRLRSDDTAVYFCTRDAGGPQTYYYDSSGFEFDSWGQGTLVIVSS

SEQ ID NO: 891 - protein, 123 aa, Homo sapiens
QVQLVQSGAEVKKPGASVKVSCGTSGYTFANYYIHWLRQAPGQGLEWMAWINPSGGSTIYSENFEGRVTVTRDTSMKTAYMELDSLTSGDTAVYYCARDATPVTTEFDYWGQGTLITVSSRLH

SEQ ID NO: 892 - protein, 137 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSGSASAPTLFPSSPLRIP

SEQ ID NO: 893 - protein, 120 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSS

SEQ ID NO: 894 - protein, 126 aa, Homo sapiens
QVQLVQSGAEVKKPGASVKVSCGTSGYTFTNYYIHWVRQAPGHGLEWMAWINPSGGATIYAEAFEGRVAVTTDTSMKTVYMELESLTSGDTAMYFCARDATPITTEFDYWGQGTLITVSSRLHQRP

SEQ ID NO: 895 - protein, 120 aa, Homo sapiens; identical to SEQ ID NO: 893

SEQ ID NO: 896 - protein, 128 aa, Homo sapiens
QVQLVQSGAEVKRPGASVRVACKTSGYTFTDYHIHWVRQAPGQGLEWMGYFNPRTGETDYAQKFQDRITMTGDVSMSTAYLELSGLRSGDTAVYYCARPLALYCSSSKCYTLWALDIWGQGQWSPSLQ

SEQ ID NO: 897 - protein, 120 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCTRDATPITTEFDYWGQGTLITVSS

SEQ ID NO: 898 - protein, 126 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRP

SEQ ID NO: 899 - protein, 136 aa, Homo sapiens
QVQLVQSGAEVKKPGASVKVSCGTSGYTFTNYYIHWVRQAPGHGLEWMAWINPSGGATIYAEAFEGRVTVTTDTSTKTVYMELESLTSGDTAMYFCARDATPITTEFDYWGQGTLITVSSASTKGPSVFPRGHPPP

SEQ ID NO: 900 - protein, 118 aa, Homo sapiens
QVQLVQSGAEVKKPGASVKVSCGTSGYTFTNYYIHWVRQAPWTWAVDGLDQPRWCHNLCRGFGQVTVTTDTSMKTVYMELESLTSGDTAMYFCARDATPITTELNYWGPGNTDHRLLT

SEQ ID NO: 901 - protein, 121 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSS

SEQ ID NO: 902 - protein, 138 aa, Homo sapiens
QVQLVQSGAEVKRPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTRPIGLPLGHPPPTT

SEQ ID NO: 903 - protein, 123 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMDWSSLTSGDTAMYFCARDATPITTEFDYWGQGTLITVSSRLH

SEQ ID NO: 904 - protein, 123 aa, Homo sapiens
QVQLVQSGAEVKKPGASVKVSCGTSGYTFTNYYIHWVRQAPGHGLEWMAWINPSGGATIHAEAFEGRVTVTTDTSMKTVYMELESLTSGDTAMYFCARDATPITTEFDYWGQGTLITVSSRLH

SEQ ID NO: 905 - protein, 133 aa, Homo sapiens
QVQLVQSGAEVKKPGASVKASCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRPIRSFPLG

SEQ ID NO: 906 - protein, 122 aa, Homo sapiens
QVQLVRSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLTHRLLTP

SEQ ID NO: 907 - protein, 118 aa, Homo sapiens
QVQLVQSGSEVKKPGASVKVSCGTSGYTFSNHYIHWVRQAPGHGLEWMAWINPSGGATIYSENFEGRVTVTRDTSMKTVYMELNSLTSGDTAVYYCARDATPITTEFDYWGQGHSPSP

SEQ ID NO: 908 - protein, 124 aa, Homo sapiens
QVQLVQSGAEVKKPGASVKVSCGTSGYAFTNYYIHWVRQAPGHGLEWMAWINPSGGATIYAEAFEGRVTVTTDTSMKTVYMELESLTSGDTAMYFCARDATPITTEFDYWGQGTLITVSSRLHQ

SEQ ID NO: 909 - protein, 120 aa, Homo sapiens
QVQLVQSGAEVKKPGASVKVSCGTSGYTFTNYYIHWVRQAPGHGLEWMAWINPSGGATIYAEAFEGRVTVTTGTSMKTVYMELESLTSGDTAMYFCARDATPITTEFDYWGQGTLITVSS

SEQ ID NO: 910 - protein, 124 aa, Homo sapiens
QVQLVQSGAEVKKPGASVKVSCGTSGYTFTNYYIQLGAAGPWTWAVDGLDQPRWCHNLCRGFGQGHRNTDTSMKTVYMELESLTSGDTAMYFCARDATPITTEFDYWGQGTLITVSSRLHRTGP

SEQ ID NO: 911 - protein, 120 aa, Homo sapiens
QVQLVQSGAEVKKPGASVKVSCGTSGYTFTNYYIHWVRRAPGHGLEWMAWINPSGGATIYAEAFEGRVTVTTDTSMKTVYMELESLTSGDTAMYFCARDATPITTEFDYWGQGTLITVSS

SEQ ID NO: 912 - protein, 123 aa, Homo sapiens
QVQLVRSGPAVKKPGTSVKVSCKASRYSFTAFYMHWVRQAPRHGLEWVGWIEPNSGGTSYGQRFQGRVTLTRDASINTFYMELSSLTDDDSAVYYCARDGGGSAFHGPYDLWGQGHWSPSLQP

SEQ ID NO: 913 - protein, 120 aa, Homo sapiens
QVQLVQSGAEVKKPGASVKVSCGTSGYTFTNYYIHWVRQAPGHGLEWMAWINPSGGATIYAEAFESRVTVTTDTSMKTVYMELESLTSGDTAMYFCARDATPITTEFDYWGQGTLITVSS

SEQ ID NO: 914 - protein, 139 aa, Homo sapiens
QVQLVQSGAEVKKPGASVKVSCGTSGYTFTNYYIHWVRQAPGHGFEWMAWINPSGGATIYAEAFEGRVTVTTDTSMKTVYMELESLTSGDTAMYFCARDATPITTEFDYWGQGTLITVSSGSASRPNPFPPRPPLTNFP

SEQ ID NO: 915 - protein, 120 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGGTAMYFCARDATPITTEFDYWGQGTLITVSS

SEQ ID NO: 916 - protein, 126 aa, Homo sapiens
QVQLVQSGAEVKKPGESLKISCKGSGYTFTDYYIHWVRQAPGQRLEWMGWFNPNTGGAHYGLDYQGRVTMTGDTSMTTVYMELTRLASDDTAIYYCAREGLCRTTSCQFDYWGQGTLVTVSSRLHR

SEQ ID NO: 917 - protein, 121 aa, Homo sapiens; identical to SEQ ID NO: 901

SEQ ID NO: 918 - protein, 142 aa, Homo sapiens
QVQLVQSGAEVKKPGASVKASCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTNGPSGPSPVGHPPPKTPPR

SEQ ID NO: 919 - protein, 122 aa, Homo sapiens
QVQLVRSGAEVKKPGASMRVSCQTSGYTFNSYYIHWMRQVPGQGLEWMGWINPNSGYTNYTQKFQGRVTMTRDTSINTAYLELSALRSDEAAVYYCARDFSDGWPYSFDFWGQGTLVTVSSA

SEQ ID NO: 920 - protein, 118 aa, Homo sapiens
QVQLMQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTRSPS

SEQ ID NO: 921 - protein, 127 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSNGWPYSFDFWGQGTLVTVSSRLHQRA

SEQ ID NO: 922 - protein, 139 aa, Homo sapiens
QVQLVPSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRAHPVLPPGHPPPTT

SEQ ID NO: 923 - protein, 139 aa, Homo sapiens
QVQLVQFGAEVKKPGSSVKVSCKASGYSFTDYYIHWVRQAPGKRLEWVGWFNPKTGGAHYGLDYQGRVTMTGGTSITTVYMELTRLASDDTAMYYCAREEFENYQLPIDFWGQGTLVTVFSASTNGHPVFPLGHPPPTT

SEQ ID NO: 924 - protein, 122 aa, Homo sapiens
QVQLVQSGSEVKKPGASVKVSCGTSGYTFSNHYIHWVRQAPGHGLEWMAWINPSGGATIYSENFEGRVTVTRDTSMKTVYMELNSLTSGDTAVYYCARDATPITTEFDYWGQGTLITVSSRL

SEQ ID NO: 925 - protein, 133 aa, Homo sapiens
QVQLVQSGAEVKKPGASVKVSCGTSGYTFTNYYIHWVRQAPGHGLEWMAWINPSGGATIYAEAFEGRVTVTTDTSMKTLHGVGEPDIWRHGHVFLRQRCDSGLRNLTTWGQGTLITVSSRLHQRAHSGPSPVG

SEQ ID NO: 926 - protein, 135 aa, Homo sapiens
QVQLVQSGAEVKKPGASVKVSCGTSGYTFTNYYIHWVRQAPGHGLEWMAWINPGGGATIYAEAFEGRVTVTTDTSMKTVYMELESLTSGDTAMYFCARDATPITTEFDYWGQGTLITVSSRLHQGPIRSFPLGHP

SEQ ID NO: 927 - protein, 120 aa, Homo sapiens
QVQLVQSGAEVKKPGVSVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSS

SEQ ID NO: 928 - protein, 126 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELENLTSGDTAMYFCARDATPITTEFDYWGQGTLITVSSRLHQRA

SEQ ID NO: 929 - protein, 116 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARVLRTVGLTPSTSWGQGTR

SEQ ID NO: 930 - protein, 146 aa, Homo sapiens
QVQLVQSGAEVKKPGASVKVSCKASRYTVNGRFIHWVRQAPGQGLEWLGWIKPNSESTNYAWKFRGRVSMTGDTSINTVYMELRSLRSDDTAVYYCASCDRRGGICIDVEGGGYYAMDVWGQGTSVTVSSASTKGPSVFPLAPCSR

SEQ ID NO: 931 - protein, 127 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSRLHQRA

SEQ ID NO: 932 - protein, 122 aa, Homo sapiens
QVQLVQSGAEVKKPGSSVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRL

SEQ ID NO: 933 - protein, 119 aa, Homo sapiens
QVQLVQSGPEVKKPGASLKVSCKASGYTFIDYYIHWVRQVPGQRLEWMGWINPKTTGALYADNFQGRVTMTRDTSISTAYMELRNLRSEDTAVYYCARWGVELLVWTSWGQGDPRSPSP

SEQ ID NO: 934 - protein, 162 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKAHRSSPWHPPPTTHLWGTAALGCLVKDYFPNRRCRGT

SEQ ID NO: 935 - protein, 120 aa, Homo sapiens
QVQLVQSGAEVKKPGASVKVSCGTSGYTFTNYYIHWVRQAPGHGLEWMAWINPSGSATIYAEAFEGRVTVTTDTSMKTVYMELESLTSGDTAMYFCARDATPITTEFDYWGQGTLITVSS

SEQ ID NO: 936 - protein, 122 aa, Homo sapiens; identical to SEQ ID NO: 924

SEQ ID NO: 937 - protein, 122 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTATYFCARDATPITTEFDYWGQGTLITVSSRL

SEQ ID NO: 938 - protein, 128 aa, Homo sapiens
QVQLVRSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTKAHRS

SEQ ID NO: 939 - protein, 123 aa, Homo sapiens
QVQLVQSGAEVKKPGASVKVSCGTSGYTFINYYIHWVRQAPGHGLEWMAWINPSGGATIYAEAFEGRVTVTTDTSMKTVYMELESLTSGDTAMYFCARDATPITTEFDYWGQGTLITVSSAST

SEQ ID NO: 940 - protein, 122 aa, Homo sapiens
QVQLVQSGAEVKKPGASVKVSCGTSGYTFTNYYIHWVRQAPGHGLEWMAWVNPSGGATIYAEAFEGRVTVTTDTSMKTVYMELESLTSGDTAMYFCARDATPITTELTTWGQGTLITVSSRL

SEQ ID NO: 941 - protein, 120 aa, Homo sapiens; identical to SEQ ID NO: 893

SEQ ID NO: 942 - protein, 120 aa, Homo sapiens; identical to SEQ ID NO: 893

SEQ ID NO: 943 - protein, 123 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLH

SEQ ID NO: 944 - protein, 120 aa, Homo sapiens; identical to SEQ ID NO: 893

SEQ ID NO: 945 - protein, 120 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCAEMRLRLRNLTTWGQGTLITVSSR

SEQ ID NO: 946 - protein, 123 aa, Homo sapiens; identical to SEQ ID NO: 943

SEQ ID NO: 947 - protein, 121 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLTPPSPH

SEQ ID NO: 948 - protein, 134 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRPHQRAHSGPSPSA

SEQ ID NO: 949 - protein, 122 aa, Homo sapiens
QVQLVQSGPAVKKPGTSVKVSCKASRYSFTAFYMHWVRQAPRHGLEWVGWIEPNSGGTSYGQRFQGRVTLTRDASINTFYMELSSLTDDDSAVYYCARDGGGSAFHGPYDLWGQGTLVTVSS

SEQ ID NO: 950 - protein, 120 aa, Homo sapiens; identical to SEQ ID NO: 893

SEQ ID NO: 951 - protein, 142 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTNGPLGPSPSATLLPTTPPR

SEQ ID NO: 952 - protein, 123 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSAST

SEQ ID NO: 953 - protein, 148 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTKAHRSSPWHPPPRRTSGAQQPWLPG

SEQ ID NO: 954 - protein, 138 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKAHRSSPWPPSSND

SEQ ID NO: 955 - protein, 123 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTDLTTWGQGTLITVSSRLH

SEQ ID NO: 956 - protein, 119 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGLSPSP

SEQ ID NO: 957 - protein, 123 aa, Homo sapiens; identical to SEQ ID NO: 943

SEQ ID NO: 958 - protein, 126 aa, Homo sapiens; identical to SEQ ID NO: 898

SEQ ID NO: 959 - protein, 120 aa, Homo sapiens; identical to SEQ ID NO: 893

SEQ ID NO: 960 - protein, 122 aa, Homo sapiens; identical to SEQ ID NO: 884

SEQ ID NO: 961 - protein, 124 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSAST

SEQ ID NO: 962 - protein, 123 aa, Homo sapiens; identical to SEQ ID NO: 943

SEQ ID NO: 963 - protein, 120 aa, Homo sapiens; identical to SEQ ID NO: 893

SEQ ID NO: 964 - protein, 120 aa, Homo sapiens; identical to SEQ ID NO: 893

SEQ ID NO: 965 - protein, 126 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRA

SEQ ID NO: 966 - protein, 126 aa, Homo sapiens; identical to SEQ ID NO: 898

SEQ ID NO: 967 - protein, 120 aa, Homo sapiens
QVQLVQSGVEVKKPGASMKVSCKASGYSFTDYYIHWVRQAPGKRLEWVGWFNPKTGGAHYGLDYQGRVTMTGDTSITTVYMELTRLASDDTAMYYCAREGVCRTTSCQFDFWGQGWSPSS

SEQ ID NO: 968 - protein, 124 aa, Homo sapiens; identical to SEQ ID NO: 961

SEQ ID NO: 969 - protein, 124 aa, Homo sapiens
QVQLVQSGAEMKKPGASVRVSCRASGYSLSDYGMHWVRQAPGQGLEWMGWIRQNSGGATYAQKFQGRVIMSRDTSITTDFIELSSLTLDDTAVYYCARAQRPVADALELDYWGQGTLVTVSSAS

SEQ ID NO: 970 - protein, 120 aa, Homo sapiens; identical to SEQ ID NO: 893

SEQ ID NO: 971 - protein, 121 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSR

SEQ ID NO: 972 - protein, 120 aa, Homo sapiens
QVQLVQSGAEVKKPGASVKVSCGTSGYTFTNDYIHWVRQAPGHGLEWMAWINPSGGATIYAEAFEGRVTVTTDTSMKTVYMELESLTSGDTAMYFCARDATPITTEFDYWGQGTLITVSS

SEQ ID NO: 973 - protein, 124 aa, Homo sapiens; identical to SEQ ID NO: 961

SEQ ID NO: 974 - protein, 122 aa, Homo sapiens
QVQLVQSGAEVKKPGASVKVSCGTSGYTFTNYYIHWVRQAPGHGLEWMAWINPSGGATIYAEAFEGRVTVTTDTSMNTVYMELESLTSGDTAMYYCARDATPITYGIDYWGQGTLITVSSRL

SEQ ID NO: 975 - protein, 141 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRPTRSFPLGHPPPTTPP

SEQ ID NO: 976 - protein, 120 aa, Homo sapiens
QVQLVQSGSEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSS

SEQ ID NO: 977 - protein, 123 aa, Homo sapiens
QVQLVQSGGEVKTPGASVKVSCRTSGYTFTAYYIHWVRQAPGHGLEWVGWINPSGGATIYAQKFEGRVTLTSDTSISTAYLELSNLRPDDTATYYCVRDATPVTTEFDFWGQGALVTVSSRLH

SEQ ID NO: 978 - protein, 122 aa, Homo sapiens; identical to SEQ ID NO: 884

SEQ ID NO: 979 - protein, 147 aa, Homo sapiens
QVQLVQSGAEVKRPGASVRVACKTSGYTFTDYHIHWVRQAPGQGLEWMGYFNPRTGETDYAQRFQDRITMTGDVSMSTAYMELSGLRSGDTAVYYCARPLALYCSSSKCYTLWALDIWGQGTMVTVSASSTKGPSVFPLAPCSRTHL

SEQ ID NO: 980 - protein, 120 aa, Homo sapiens; identical to SEQ ID NO: 893

SEQ ID NO: 981 - protein, 140 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTELTTWGQGTLITVSSRLHRTAHSGPSPSATLLPTT

SEQ ID NO: 982 - protein, 122 aa, Homo sapiens; identical to SEQ ID NO: 884

SEQ ID NO: 983 - protein, 115 aa, Homo sapiens
QVQLVQSGAELRKSGASAKVSCTATGYTSTAYYVHWVRQAPGQGLGWMGCINPQSDDTKYAQKFQGRVTMTRDTSTNTAYMELSGLTFDDTAMYYCLTAIDGIVYWGQGPLVHRF

SEQ ID NO: 984 - protein, 134 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHRTAHSGPSPVG

SEQ ID NO: 985 - protein, 120 aa, Homo sapiens; identical to SEQ ID NO: 893

SEQ ID NO: 986 - protein, 121 aa, Homo sapiens; identical to SEQ ID NO: 901

SEQ ID NO: 987 - protein, 120 aa, Homo sapiens; identical to SEQ ID NO: 893

SEQ ID NO: 988 - protein, 121 aa, Homo sapiens; identical to SEQ ID NO: 901

SEQ ID NO: 989 - protein, 134 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRPIGPSPSAT

SEQ ID NO: 990 - protein, 120 aa, Homo sapiens; identical to SEQ ID NO: 893

SEQ ID NO: 991 - protein, 121 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTELTTWGPGNTDHRLLT

SEQ ID NO: 992 - protein, 121 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGPGNSSHRLL

SEQ ID NO: 993 - protein, 134 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRPTPVLPPSA

SEQ ID NO: 994 - protein, 120 aa, Homo sapiens; identical to SEQ ID NO: 893

SEQ ID NO: 995 - protein, 122 aa, Homo sapiens
QVQLVQSGAEVKKPGASVKVPCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRL

SEQ ID NO: 996 - protein, 122 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRP

SEQ ID NO: 997 - protein, 121 aa, Homo sapiens
QVQLVQSGAEVKKPGASVKVSCGTSGYTFTNYYIHWVRQAPGHGLEWMAWINPSGGATIYAEAFEGRVTVTTDTSMKNSLHGVGEPDIWRHGHVFLTPEMRLRLRNLTTWGQGTLITVSSR

SEQ ID NO: 998 - protein, 121 aa, Homo sapiens; identical to SEQ ID NO: 901

SEQ ID NO: 999 - protein, 121 aa, Homo sapiens; identical to SEQ ID NO: 971

SEQ ID NO: 1000 - protein, 124 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQ

SEQ ID NO: 1001 - protein, 139 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRPIGPSPSATLLPTT

SEQ ID NO: 1002 - protein, 120 aa, Homo sapiens; identical to SEQ ID NO: 893

SEQ ID NO: 1003 - protein, 123 aa, Homo sapiens; identical to SEQ ID NO: 943

SEQ ID NO: 1004 - protein, 120 aa, Homo sapiens; identical to SEQ ID NO: 893

SEQ ID NO: 1005 - protein, 121 aa, Homo sapiens; identical to SEQ ID NO: 971

SEQ ID NO: 1006 - protein, 123 aa, Homo sapiens; identical to SEQ ID NO: 943

SEQ ID NO: 1007 - protein, 120 aa, Homo sapiens; identical to SEQ ID NO: 893

SEQ ID NO: 1008 - protein, 118 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITV

SEQ ID NO: 1009 - protein, 131 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTEGPSGPSP

SEQ ID NO: 1010 - protein, 137 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTTAHRSSPSAPSSND

SEQ ID NO: 1011 - protein, 121 aa, Homo sapiens; identical to SEQ ID NO: 901

SEQ ID NO: 1012 - protein, 120 aa, Homo sapiens; identical to SEQ ID NO: 893

SEQ ID NO: 1013 - protein, 148 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTNGPSGPSPWPPSSQDATSSGHDARP

SEQ ID NO: 1014 - protein, 121 aa, Homo sapiens
QVQLVQSGAEVKKPGASMRVSCQTSGYTFNSYYIHWMRQVPGQGLEWMGWISPNSGYTNYTQKFQGRVTMTRDTSINTAYLELSALRSDETAVYYCARDFSDGWPYSFDFWGQGTLVTVSS

SEQ ID NO: 1015 - protein, 120 aa, Homo sapiens; identical to SEQ ID NO: 893

SEQ ID NO: 1016 - protein, 120 aa, Homo sapiens; identical to SEQ ID NO: 893

SEQ ID NO: 1017 - protein, 124 aa, Homo sapiens; identical to SEQ ID NO: 961

SEQ ID NO: 1018 - protein, 126 aa, Homo sapiens; identical to SEQ ID NO: 965

SEQ ID NO: 1019 - protein, 151 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRAHVRSFPRRPPSSNDATSSGPRRTPV

SEQ ID NO: 1020 - protein, 122 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCAEMRLRLRNLTTWGQGTLITVSSRLH

SEQ ID NO: 1021 - protein, 141 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKAHRSSPGTSSKTHLWG

SEQ ID NO: 1022 - protein, 124 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGPGNSSHRLLSLH

SEQ ID NO: 1023 - protein, 140 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSRLHQRPIRSSPSATLLQRR

SEQ ID NO: 1024 - protein, 143 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRAHPVLPPRPPSLQRRHLV

SEQ ID NO: 1025 - protein, 135 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSGSALPPLTLFPLVLL

SEQ ID NO: 1026 - protein, 120 aa, Homo sapiens; identical to SEQ ID NO: 893

SEQ ID NO: 1027 - protein, 122 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSR

SEQ ID NO: 1028 - protein, 121 aa, Homo sapiens; identical to SEQ ID NO: 901

SEQ ID NO: 1029 - protein, 121 aa, Homo sapiens; identical to SEQ ID NO: 971

SEQ ID NO: 1030 - protein, 116 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLI

SEQ ID NO: 1031 - protein, 123 aa, Homo sapiens; identical to SEQ ID NO: 943

SEQ ID NO: 1032 - protein, 120 aa, Homo sapiens; identical to SEQ ID NO: 893

SEQ ID NO: 1033 - protein, 119 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTV

SEQ ID NO: 1034 - protein, 123 aa, Homo sapiens; identical to SEQ ID NO: 943

SEQ ID NO: 1035 - protein, 120 aa, Homo sapiens; identical to SEQ ID NO: 893

SEQ ID NO: 1036 - protein, 122 aa, Homo sapiens; identical to SEQ ID NO: 884

SEQ ID NO: 1037 - protein, 120 aa, Homo sapiens; identical to SEQ ID NO: 893

SEQ ID NO: 1038 - protein, 123 aa, Homo sapiens; identical to SEQ ID NO: 943

SEQ ID NO: 1039 - protein, 120 aa, Homo sapiens; identical to SEQ ID NO: 893

SEQ ID NO: 1040 - protein, 126 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTNGP

SEQ ID NO: 1041 - protein, 120 aa, Homo sapiens; identical to SEQ ID NO: 945

SEQ ID NO: 1042 - protein, 134 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRAHSGPSPVG

SEQ ID NO: 1043 - protein, 124 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTRSHRLLTPP

SEQ ID NO: 1044 - protein, 120 aa, Homo sapiens; identical to SEQ ID NO: 893

SEQ ID NO: 1045 - protein, 120 aa, Homo sapiens; identical to SEQ ID NO: 893

SEQ ID NO: 1046 - protein, 126 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTRP

SEQ ID NO: 1047 - protein, 123 aa, Homo sapiens; identical to SEQ ID NO: 943

SEQ ID NO: 1048 - protein, 121 aa, Homo sapiens; identical to SEQ ID NO: 901

SEQ ID NO: 1049 - protein, 118 aa, Homo sapiens; identical to SEQ ID NO: 1008

SEQ ID NO: 1050 - protein, 120 aa, Homo sapiens; identical to SEQ ID NO: 893

SEQ ID NO: 1051 - protein, 139 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTNGPLGPSPSATLLQRR

SEQ ID NO: 1052 - protein, 137 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTNGPIRSFPLAALPP

SEQ ID NO: 1053 - protein, 123 aa, Homo sapiens; identical to SEQ ID NO: 952

SEQ ID NO: 1054 - protein, 126 aa, Homo sapiens; identical to SEQ ID NO: 965

SEQ ID NO: 1055 - protein, 121 aa, Homo sapiens; identical to SEQ ID NO: 971

SEQ ID NO: 1056 - protein, 120 aa, Homo sapiens; identical to SEQ ID NO: 893

SEQ ID NO: 1057 - protein, 120 aa, Homo sapiens; identical to SEQ ID NO: 893

SEQ ID NO: 1058 - protein, 135 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHRRPIGPSPSATL

SEQ ID NO: 1059 - protein, 121 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSA

SEQ ID NO: 1060 - protein, 120 aa, Homo sapiens; identical to SEQ ID NO: 893

SEQ ID NO: 1061 - protein, 120 aa, Homo sapiens; identical to SEQ ID NO: 893

SEQ ID NO: 1062 - protein, 123 aa, Homo sapiens; identical to SEQ ID NO: 943

SEQ ID NO: 1063 - protein, 134 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHRTAQSGPSPVG

SEQ ID NO: 1064 - protein, 122 aa, Homo sapiens; identical to SEQ ID NO: 884

SEQ ID NO: 1065 - protein, 132 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSGMHSRPPFSPSS

SEQ ID NO: 1066 - protein, 124 aa, Homo sapiens; identical to SEQ ID NO: 1000

SEQ ID NO: 1067 - protein, 122 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTELTTWGPGNTDHRLLTP

SEQ ID NO: 1068 - protein, 115 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTL

SEQ ID NO: 1069 - protein, 122 aa, Homo sapiens; identical to SEQ ID NO: 884

SEQ ID NO: 1070 - protein, 127 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTNGP

SEQ ID NO: 1071 - protein, 120 aa, Homo sapiens; identical to SEQ ID NO: 893

SEQ ID NO: 1072 - protein, 121 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITYGIDYWGQGTLITVSSR

SEQ ID NO: 1073 - protein, 126 aa, Homo sapiens; identical to SEQ ID NO: 965

SEQ ID NO: 1074 - protein, 116 aa, Homo sapiens; identical to SEQ ID NO: 1030

SEQ ID NO: 1075 - protein, 122 aa, Homo sapiens; identical to SEQ ID NO: 884

SEQ ID NO: 1076 - protein, 120 aa, Homo sapiens
QVQLVQSGAEVKKPGASVKVSCGTSGYTFTNYYIHWVRQAPGHGLEWMAWINPSGGATIYAEAFEGRVTVTTDTSMKNSLHGVGEPDICDTAMYFCARDATPITTEFDYWGQGTLITVSS

SEQ ID NO: 1077 - protein, 115 aa, Homo sapiens; identical to SEQ ID NO: 1068

SEQ ID NO: 1078 - protein, 135 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTNGPSGPSPVGHP

SEQ ID NO: 1079 - protein, 138 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQGPSVLPPRPPSSND

SEQ ID NO: 1080 - protein, 120 aa, Homo sapiens; identical to SEQ ID NO: 893

SEQ ID NO: 1081 - protein, 121 aa, Homo sapiens; identical to SEQ ID NO: 901

SEQ ID NO: 1082 - protein, 122 aa, Homo sapiens; identical to SEQ ID NO: 884

SEQ ID NO: 1083 - protein, 121 aa, Homo sapiens; identical to SEQ ID NO: 971

SEQ ID NO: 1084 - protein, 138 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVCYCARDFSDGWPYSFDFWGQGTLATVSSASTKAHRSSPGHPPPTT

SEQ ID NO: 1085 - protein, 121 aa, Homo sapiens; identical to SEQ ID NO: 901

SEQ ID NO: 1086 - protein, 121 aa, Homo sapiens; identical to SEQ ID NO: 971

SEQ ID NO: 1087 - protein, 120 aa, Homo sapiens; identical to SEQ ID NO: 893

SEQ ID NO: 1088 - protein, 150 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTKGPSVFPLATLLQRRTSGGTAALGCLV

SEQ ID NO: 1089 - protein, 151 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKGPSVFPLATLLQRRTSGAQRPWAAWS

SEQ ID NO: 1090 - protein, 120 aa, Homo sapiens; identical to SEQ ID NO: 893

SEQ ID NO: 1091 - protein, 124 aa, Homo sapiens; identical to SEQ ID NO: 1000

SEQ ID NO: 1092 - protein, 121 aa, Homo sapiens; identical to SEQ ID NO: 971

SEQ ID NO: 1093 - protein, 125 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTKA

SEQ ID NO: 1094 - protein, 121 aa, Homo sapiens; identical to SEQ ID NO: 971

SEQ ID NO: 1095 - protein, 114 aa, Homo sapiens
QVQLVQSGAEVKKPGASVKVSCGTSGYTFTNYYIHWVRQAPGHGLEWMAWINPSGGATIYAEAFEGRVTVTTDTSMKTSLHGVGEPDIWRHGHVFLRQRCDSELRNLTTWGQGT

SEQ ID NO: 1096 - protein, 115 aa, Homo sapiens; identical to SEQ ID NO: 1068

SEQ ID NO: 1097 - protein, 128 aa, Homo sapiens
QVQLVQSGAEVKKPGASVRASCRASGYSLSDYGMHWVRQAPGQGLEWMGWIKQNSGGATYAQKFQGRVIMSRDTSITTDFIELSSLTLDDTAVYYCARAQRPVADALELDYWGRGNTGHRLVSLHQRA

SEQ ID NO: 1098 - protein, 123 aa, Homo sapiens; identical to SEQ ID NO: 943

SEQ ID NO: 1099 - protein, 126 aa, Homo sapiens; identical to SEQ ID NO: 898

SEQ ID NO: 1100 - protein, 139 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSASTNGPIRSSPSATLLQRR

SEQ ID NO: 1101 - protein, 120 aa, Homo sapiens; identical to SEQ ID NO: 893

SEQ ID NO: 1102 - protein, 122 aa, Homo sapiens; identical to SEQ ID NO: 884

SEQ ID NO: 1103 - protein, 123 aa, Homo sapiens; identical to SEQ ID NO: 943

SEQ ID NO: 1104 - protein, 121 aa, Homo sapiens; identical to SEQ ID NO: 901

SEQ ID NO: 1105 - protein, 120 aa, Homo sapiens
QVQLVQSGAEVKKPGASVKVSCGTSGYTFTNYYIHWVRQAPGHGLEWMAWINPSGGVTIYAEAFEGRVTVTTDTSMKTVYMELESLTSGDTAMYFCARDATPITTEFDYWGQGTLITVSS

SEQ ID NO: 1106 - protein, 142 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKAHRSSPGTLLQDAPLGH

SEQ ID NO: 1107 - protein, 120 aa, Homo sapiens; identical to SEQ ID NO: 893

SEQ ID NO: 1108 - protein, 123 aa, Homo sapiens; identical to SEQ ID NO: 943

SEQ ID NO: 1109 - protein, 123 aa, Homo sapiens; identical to SEQ ID NO: 943

SEQ ID NO: 1110 - protein, 120 aa, Homo sapiens; identical to SEQ ID NO: 893

SEQ ID NO: 1111 - protein, 138 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKGPSGLPPGHPPPT

SEQ ID NO: 1112 - protein, 120 aa, Homo sapiens; identical to SEQ ID NO: 893

SEQ ID NO: 1113 - protein, 122 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSA

SEQ ID NO: 1114 - protein, 115 aa, Homo sapiens
QVQLVQSGAELRKSGASAKVSCTATGYTFTAYYVHWVRQAPGQGLGWMGCINPQSDDTKYAQKFQGRVTMTRDTSTNTAYMELSGLTFDDTAMYYCLTAIDGIVYWGQGPLVHRF

SEQ ID NO: 1115 - protein, 121 aa, Homo sapiens; identical to SEQ ID NO: 901

SEQ ID NO: 1116 - protein, 121 aa, Homo sapiens; identical to SEQ ID NO: 901

SEQ ID NO: 1117 - protein, 124 aa, Homo sapiens; identical to SEQ ID NO: 961

SEQ ID NO: 1118 - protein, 138 aa, Homo sapiens; identical to SEQ ID NO: 954

SEQ ID NO: 1119 - protein, 121 aa, Homo sapiens; identical to SEQ ID NO: 901

SEQ ID NO: 1120 - protein, 121 aa, Homo sapiens; identical to SEQ ID NO: 1059

SEQ ID NO: 1121 - protein, 126 aa, Homo sapiens
QVQLVQSGAEVKKPGASVKVSCKASGYTFTDYFVHWVRQAPGQNFEWMGWTNVNTGGTKYAPKFQDRVTFTTDESKTTAYMELRSLRSEDTAVYYCARNTGAVATSLYSLGVWGQGTTVAVSSAST

SEQ ID NO: 1122 - protein, 153 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKGPSVFPLAPSSKSTSGAHAALGCLVKDY

SEQ ID NO: 1123 - protein, 124 aa, Homo sapiens; identical to SEQ ID NO: 961

SEQ ID NO: 1124 - protein, 116 aa, Homo sapiens
QVQLVQSEAEVKKPGASMKVSCKASGYSFTDYYIYWVRQVPGQGLEWMGWINPNSGGTNYAQRFQDKVSMTRDTSISTAYMELRRLISDDTAIYFCLTALDGVAYWGQGTLVTVSS

SEQ ID NO: 1125 - protein, 119 aa, Homo sapiens; identical to SEQ ID NO: 956

SEQ ID NO: 1126 - protein, 121 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGCLTPSTSWGQGTLVTVSS

SEQ ID NO: 1127 - protein, 124 aa, Homo sapiens; identical to SEQ ID NO: 961

SEQ ID NO: 1128 - protein, 153 aa, Homo sapiens
QVQLVQSGAEVKKPGSSVKVSCKASGGTFSDYGVHWVRQAPGQGLEWMGWINHFSGGATYAEVFQGRVAMTRDTSINTAFMELRSLKFDDTALYYCARAQRPVADALELDLWGQGTLVTVSSASTKGPSVFPLATLLQDAPPRAQRPWAAWSR

SEQ ID NO: 1129 - protein, 121 aa, Homo sapiens; identical to SEQ ID NO: 901

SEQ ID NO: 1130 - protein, 144 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHQRPTPVLPPRPPSSQRRHLVG

SEQ ID NO: 1131 - protein, 142 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTRPSVFPWHPPPRRTSRGT

SEQ ID NO: 1132 - protein, 121 aa, Homo sapiens; identical to SEQ ID NO: 901

SEQ ID NO: 1133 - protein, 123 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSAS

SEQ ID NO: 1134 - protein, 127 aa, Homo sapiens; identical to SEQ ID NO: 1070

SEQ ID NO: 1135 - protein, 126 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAMYFCARDATPITTEFDYWGQGTLITVSSRLHRTA

SEQ ID NO: 1136 - protein, 139 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTNGPSVFPLATLLQRR

SEQ ID NO: 1137 - protein, 125 aa, Homo sapiens
QVQLVQSGAEVKKPGASVKVSCKTSGYTFTSYDVNWVRQAPGQRLEWIGWFNPNTGGAHYGLDYQGRVTMTGDTSITTVYMELTRLASDDTAIYYCAREGLCRTTSCQFDFWGQGTLVTVFSAST

SEQ ID NO: 1138 - protein, 121 aa, Homo sapiens; identical to SEQ ID NO: 901

SEQ ID NO: 1139 - protein, 127 aa, Homo sapiens; identical to SEQ ID NO: 1070

SEQ ID NO: 1140 - protein, 121 aa, Homo sapiens; identical to SEQ ID NO: 901

SEQ ID NO: 1141 - protein, 143 aa, Homo sapiens
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSSASTKAHRSSPWPPSSKTHLWGT

SEQ ID NO: 1142 - protein, 121 aa, Homo sapiens; identical to SEQ ID NO: 901

SEQ ID NO: 1143 - protein, 124 aa, Homo sapiens; identical to SEQ ID NO: 961

SEQ ID NO: 1144 - protein, 125 aa, Homo sapiens; identical to SEQ ID NO: 1093

SEQ ID NO: 1145 - protein, 123 aa, Homo sapiens
QVQLVQSGAEVKKPGASVKVSCKASGYTFTDYFVHWVRQAPGQNFEWMGWTNVNTGGTKYAPKFQDRVTFTTDESKTTAYMELRSLRSEDTAVYYCARNTGAVATSLYSLGVWGQGTTVAVSS

SEQ ID NO: 1146 - protein, 121 aa, Homo sapiens; identical to SEQ ID NO: 901

SEQ ID NO: 1147 - protein, 121 aa, Homo sapiens; identical to SEQ ID NO: 901

SEQ ID NO: 1148 - protein, 139 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAVYFCARDATPITTEFDYWGQGTLITVSSRLHQRPIGPSPSATLLQRR

SEQ ID NO: 1149 - protein, 124 aa, Homo sapiens; identical to SEQ ID NO: 961

SEQ ID NO: 1150 - protein, 120 aa, Homo sapiens
QVQLVQSGAEVKKPGASVKVSCGTSGYTFTNYYIHWVRQAPGHGLEWMAWINPSGGATIYAEAFEGRVTVTTDTSMKTVYMELESLTSGDTAVYFCARDATPITTEFDYWGQGTLITVSS

SEQ ID NO: 1151 - protein, 127 aa, Homo sapiens; identical to SEQ ID NO: 1070

SEQ ID NO: 1152 - protein, 120 aa, Homo sapiens
QVQLVQSGAEVKTPGASVKVSCRTSGYTFTAYYIHWVRQALGHGLEWVGWINPSGGATIYAQKFEGRVTLTSDTSISTAYLELSNLRPDDTATYYCVRDATPVTTEFDFWGQGALVTVSS

SEQ ID NO: 1153 - protein, 125 aa, Homo sapiens
QVQLVQSGPEVKKPGASLKVSCKASEYTFIDYYIHWVRQVPGQRLEWMGWINPKTTGALYADNFQGRVTMTSDTSINTVYMEVTRLTSDDTAVYFCAREGHCSSTNCFFDSWGQGTLVTVSSAST

SEQ ID NO: 1154 - protein, 124 aa, Homo sapiens
QVQLVQSGAEVKKPGASMRVSCQTSGYTFNSYYIHWMRQVPGQGLEWMGGLTPNSGYTNYTQKFQGRVTMTRDTSINTAYLELSALRSDETAVYYCARDFSDGWPYSFDFWGQGTLVTVSSAST

SEQ ID NO: 1155 - protein, 116 aa, Homo sapiens
QVQLVQSGAELRKSGASAKVSCTATGYTFTAYYVHWVRQAPGQGLEWMGCINPQSDDTKYAQKFQGRVTMTRDTSTNTAYMELSGLTFDDTAMYYCLTAIDGIVYWGQGPLVHRFL

SEQ ID NO: 1156 - protein, 112 aa, Homo sapiens
QVQLVQSGAELRKSGASAKVSCTATGYTFTAYYVHWVRQAPGQGLEWMGCINPQSDDTKYAQKFQGEVTMTRDTSTNTAYMELSGLTFDDTAMYYCLTAIDGIVYWGQGPLV

SEQ ID NO: 1157 - protein, 121 aa, Homo sapiens
QVQLVQSGAEVKRPGASVRVSCRTSGYSFTAYYIHWVRQAPGQGLEWMGRLNPNTGGADSSQKFQGRVTLTRDTSINTAYMDLRRLRVDDSATYYCASGIQAGGANYWGQGTLVTVSSAST

SEQ ID NO: 1158 - protein, 122 aa, Homo sapiens
QVQLGQSGAEMKKPGASVMLSCKTSGYNFIDYYIYWVRLAPGRGLQWMGWINPNRGGTKYAETFRDRLTMTRDTPVSTAYMELNNLRSDDTAVYYCARLQSLHGLYSNADYWGQGTLVTVSS

SEQ ID NO: 1159 - protein, 125 aa, Homo sapiens
QVQLVQSGPEVKKPGASLKVSCKASGYTFIDYYIHWVRQVPGQRLEWMGWINPKTTGALYADNFQGRVTMTSDTSINTVYMEVTRLTSDDTAVYYCAREGHCSSTNCFLTRWGQGTLVTVSSRLH

SEQ ID NO: 1160 - protein, 115 aa, Homo sapiens
QVQLVQSGAELRKSGASAKVSCTATGYTFTAYYVHWVRQAPGQGLEWMGCINPQSDDTKYAQKFQGRVTMTRDTSTNTAYMELSGLTFDDTAMYYCLTAIDGIVYWGQGPLVHRF

SEQ ID NO: 1161 - protein, 120 aa, Homo sapiens
QVQLVQSGTDVRKPGASVKVSCKASGYTFSDYYIHWVRQAPGQRLEWIGWFNPNTGGAHYGLDYQGRVTMTGDTSITTVYMELTRLASDDTAIYYCAREGLELLAANLTSWGQGRWSPSS

SEQ ID NO: 1162 - protein, 124 aa, Homo sapiens
QVQLVQSGAEVKRPGASVRVSCKASGYSFTAYFLHWVRQAPGQGLEFMGRLNPNTGATDFPQKFQGRVTVTRDTSISTAYMEVYGLRPEDTAVYYCAAGIQAGGANYWGQGTLVTVSSASTKGP

SEQ ID NO: 1163 - protein, 115 aa, Homo sapiens
QVQLVQSGAEVKTPGASVKVSCRTSGYTFTAYYIHWVRQAPGHGLEWVGWINCNSAGTFYAQKFQGRVIMTRDTSNNTVYMQLNSLNSDDTAVYYCARVTSPGVWGKGTTVTVSS

SEQ ID NO: 1164 - protein, 135 aa, Homo sapiens
QVQLVQSGAEVKKPGASVKVSCKASGYTFTDYYLHWVRQAPGQGLEWMGWIMPNTGGVHSSPKFQGRFSVTRDTSTSTAYMQLSRLTSDDTAVYYCARTDGDFIDYWGQGTLVTVSSASTKGPSVFPWRPASRTH

SEQ ID NO: 1165 - protein, 126 aa, Homo sapiens
QVQLVQSGTEVRNPGASVKVSCKASGYRFTDYFIHWMRQAPGQGLEWMGWIDPHGGGTNYAQKFQGRVTLVRDASISMAYMELSSLTSDDTALYFCAREVDTSLDLLIYYMDVWGKGPRSPSPQGV

SEQ ID NO: 1166 - protein, 140 aa, Homo sapiens
QVQLVQSGPEVKKPGASLKVSRKASGYTFIDYYIHWVRQVPGQRLEWMGWINPKTTGALYADNFQGRVTMTSDTSINTVYMEVTRLTSDDTAVYYCAREGHCSSTNCFFDSWGQGTLVTVSSASTNGPIGLPPGHPPPTT

SEQ ID NO: 1167 - protein, 118 aa, Homo sapiens
QVQLVQSGSEMKKPGASVKVSCKTSGYTFTDYYIHWVRQAPGQGLEWMGWINCNSAGTFYAQKFQGRVIMTRDTSNNTVYMQLNSLNSDDTAVYYCARVSPPDVWGKGTTVTVSSAST

SEQ ID NO: 1168 - protein, 118 aa, Homo sapiens
QVQLGQSGAEMKKPGASVMLSCKTSGYNFIDYYIYWVRLAPGRGLQWMGWINPNRGGTKYAETFRDRLTMTRDTSVSTAYMELNNLRSDDTAVYYCARLQSLHGLYSNADYWGQGTLV

SEQ ID NO: 1169 - protein, 123 aa, Homo sapiens
QVQLVQSGAEVKKPGASVRVTCRASGFSVSDYGVHWVRQAPGQGLEWMGWINHFSGGATYAEVFQGRVAMTRDTSINTAFMELRSLRSDDTAVYYCARDTPRYCSSTSCYMEVWGKGTTVTVS

SEQ ID NO: 1170 - protein, 120 aa, Homo sapiens
QVQLVQSGAEMKKPGASVKVSCKTSGYTFTDYYIHWVRQAPGHGLEWMAWINPSGGATIYAEAFEGRVTVTTDTSMKTVYMELESLTSGDTAMYFCARDATPITTEFDYWGQGTLITVSS

SEQ ID NO: 1171 - protein, 133 aa, Homo sapiens
QVQLVQSGAEVKTPGASVKVSCRTSGYTFTAYYIHWVRQAPGHGLEWVGWINPSGGATIYAQKFEGRVTLTSDTSISTAYLELSNLRPDDTATYYCVRDATPVTTEFDFWGQGALVTVSSRLHHGPSGPSPVG

SEQ ID NO: 1172 - protein, 124 aa, Homo sapiens
QVQLVQSGAEVKKPGASVRVSCKASGSSLHAYYIHWVRQAPGQRPEWMGWLNPNSGGTNYAPKFQDRVTLTRETSIGTTHLGLRGLGSDDTAVYYCATDRLGPQGYINYYFESWGQGALITVSS

SEQ ID NO: 1173 - protein, 120 aa, Homo sapiens
QVQLVQVWVEVKKPWASMKVSCKASGYNFTGYFIHWVRQGPGQGLEWMGWMNPNTGGAKYAQKFQGRVTMTRDTSIRTAYMELSSLKTRDTAVYYCARDPQDGTTWYTHWGQGTLVTVSS

SEQ ID NO: 1174 - protein, 122 aa, Homo sapiens
QVQLVQSGTEVKKPGASLKVSCKASGYTFIDYYIHWVRQVPGQRLEWMGWINPKTTGALYADNFQGRVTMTSDTSINTVYMEVTRLTSDDTALYYCAREGHCGSTNCFFDFWGQGTLVTVSS

SEQ ID NO: 1175 - protein, 122 aa, Homo sapiens
QVQLGQSGAEMKKPGASVMLSCKTSGYNFIDYYIYWVRLAPGRGLQWMGWINPNRGGTKYAETFRDRLTMTRDTSVSTAYMELNNLRSDDTAVYYCARLQSLHGLYSNADYWGQGTLVTVSS

SEQ ID NO: 1176 - protein, 148 aa, Homo sapiens
QVQLVQSGAELRKSGASAKVSCTATGYTFTAYYVHWVRQAPGQGLEWMGCINPQSDDTKYAQKFQGRVTMTRDTSTNTAYMELSGLTFDDTAMYYCLTAIDGIVYWGQGPLVTVSSASTKGPSVFPLAPSSKSTSGGTAALAAWSRTT

SEQ ID NO: 1177 - protein, 127 aa, Homo sapiens
QVQLVQSGAEVKKPGASVRVSCKASGSSLHAYYIHWVRQAPGQRPEWMGWLNPNSGGTNYAPKFQDRVTLTRETSIGTTHLGVRGLGSDDTAVYYCATDRLGPQGYINYYFESWGQGALITVSSAST

SEQ ID NO: 1178 - protein, 115 aa, Homo sapiens
QVQLVQSGAELRKSGASAKVSCTATGYTFTAYYVHWVRQAPGQGLEWMGCINPQSDDTKYAQKFQGRVTMTRDTSTNTAYMELSGLTFDDTAMYYCLTAIDGIVYWGQGPLVTVP

SEQ ID NO: 1179 - protein, 113 aa, Homo sapiens
QVQLVQSGADVKESGASLKVSCKASGHTFAAYYVHWVRQAPGQGLEWMGWIQPNSGVTKNAQTFRGRLTMTRDTSINTVYMELSRLRFDDTALYYCTERLREWGQGSLVTVSS

SEQ ID NO: 1180 - protein, 139 aa, Homo sapiens
QVQLVQSGPEVKKPGASLKVSCKASGYTFIDYYIHWVRQVPGQRLEWMGWINPKTTGALYADNFQGRVTMTSDTSINTVYMEVTRLTSDDTAVYYCAREGHCSSTNCFFDSWGQGTLVTVSSGSASAPTLFPLVSSENS

SEQ ID NO: 1181 - protein, 116 aa, Homo sapiens; identical to SEQ ID NO: 1155

SEQ ID NO: 1182 - protein, 126 aa, Homo sapiens
QVQLVQSGSEMKKPGASVKVSCKTSGYTFTDYYIHWVRQAPGQGLEWMGWINCNSAGTFYAQKFQGRVIMTRDTSKQHCLHATEPEFRRHGRLLLCESESPGVWGKGTTVTVSSASTKGPSGLPPG

SEQ ID NO: 1183 - protein, 109 aa, Homo sapiens
QVQLVQSGAELRKSGASAKVSCTATGYTFTAYYVHWVRQAPGQGLEWMGCINPQSDDTKYAQKFQGRVTMTRDTSTNTAYMELSGLTFDDTAMYYCLTAIDGIVYWGQG

SEQ ID NO: 1184 - protein, 122 aa, Homo sapiens
QVQLVQSGAELRKSGASAKVSCTATGYTFTAYYVHWVRQAPGQGLEWMGCINPQSDDTKYAQKFQGRVTMTRDTSTNTAYMELSGLTFDDTAMYYCLTAIDGIVYWGQGPLVTVSSRLHQRT

SEQ ID NO: 1185 - protein, 121 aa, Homo sapiens
QVQLVQSGAEVRKPGASVKVSCTASGYTFTGHYILWVRQARGQGLEWVGWINGDRGDTKYSHKFQGRVVMTRDRSTSTVSMELSRLTSDDTAIYYCARDLVRDGYDALDIWGRGTLVTVSS

SEQ ID NO: 1186 - protein, 143 aa, Homo sapiens
QVQLVQSGTEVKKPGASLKVSCKASGYTFIDYYIHWVRQVPGQRLEWMGWINPKTTGALYADNFQGRVTMTSDTSINTVYMELTRLTSDDTALYYCAREGHCGSTNCLFDFWGQGTLVTVSSASTKAHRSSPAPCSRSTSETH

SEQ ID NO: 1187 - protein, 125 aa, Homo sapiens
QVQLVQSGTEVKKPGASLKVSCKASGYTFIDYYIHWVRQVPGQRLEWMGWINPKTTGALYADNFQGRVTMTSDTSINTVYMEVTRLTSDDTALYYCAREGHCGSTNCFFDFWGQGTLVTVSSAST

SEQ ID NO: 1188 - protein, 109 aa, Homo sapiens; identical to SEQ ID NO: 1183

SEQ ID NO: 1189 - protein, 140 aa, Homo sapiens
QVQLVQSGAEVKESGASVKVSCEASTYTFIGYYLHWVRQAPGQGLEWMGWINPDNGATNYAQKFQGRVTMTRVTSINTAYMDLNNLTSDDTAVYFCARAEGIWLGEPAPFDLWGQGTMVIVSLGSASAPTLFPSSPLRIP

SEQ ID NO: 1190 - protein, 122 aa, Homo sapiens
QVQLVQSGAEMKKPGASVKVSCKASGYTFTAFYIHWLRQAPGQGPEWMGWINPINGATIYAETFEGRVTLTRDTSTNTAYMELSSLKSYDTAVYYCARDAPPITTEFDQWGQGTLVTRLLSL

SEQ ID NO: 1191 - protein, 119 aa, Homo sapiens
QVQLVQSGAEVKKPGASVKVSCTATGYTFTAYYVHWVRQAPGQGLEWMGCINPQSDDTKYAQKFQGRVTMTRDTSTNTAYMELSGLTFDDTAMYYCLTAIDGIVYWGQGPLVHRFLDGT

SEQ ID NO: 1192 - protein, 126 aa, Homo sapiens
QVQLVQSGAEMMKPGATLKVSCKTSGYTFTKFYIHWVRQAPGQGLEWMGWINPTSGNTKSAQKFQGRVTMTSDTSINTAYTELSKLRSDDAAIYYCAKLADYYNSENGALEIWGQGTMVTVSSAST

SEQ ID NO: 1193 - protein, 118 aa, Homo sapiens
QVQLVQSGAEMKKPGASVKVSCKASGYTFTAFYIHWLRQAPGQGPEWMGWINPINGATIYAETFEGRVTLTRDTSTNTAYMELSSLKSYDTAVYYCARDAPPITTEFDQWGQGTLVSV

SEQ ID NO: 1194 - protein, 115 aa, Homo sapiens
QVQLVQSGAELRKSGASAKVSCTATGYTFTAYYVHWVRQAPGQGLEWMGCINPQSDDTKYAQKFQGRVTMTRDTSTNTAYMELSGLTFDDTAMYYCLTAIDGIVYWGQGTLVTVS

SEQ ID NO: 1195 - protein, 115 aa, Homo sapiens; identical to SEQ ID NO: 1160

SEQ ID NO: 1196 - protein, 128 aa, Homo sapiens
QVQLVQSGAEVRPPGASVKVSCKASGYTFTAYDMHWVRQASGQGLEWMGRVNPNNGATKVAEKFRGRVSMTTDTSITTAYMDIHGLTSDDTAVYYCARDRGDHVYYYAMDTWGRGTTVSVSSASTKGP

SEQ ID NO: 1197 - protein, 121 aa, Homo sapiens
QVQLVQSGAEVRKPGASVKVSCTASGYTFTGHYILWVRQAPGQGLEWVGWINGDRGDTKYSHKFQGRVVMTRDRSTSTVSMELSRLTSDDTAIYYCARDLVRDGYDALDIWGRGTLVTVSS

SEQ ID NO: 1198 - protein, 126 aa, Homo sapiens
QVQLVQSGAEMMKPGATLKVSCKTSGYTFTKFYIHWVRQAPGQGLEWMGWINPTSGNTKSAQKFQGRVTMTSDTSINTAYMELSKLRSDDAAIYYCAKLADYYNSENGALEIWGQGTMVTVSSAST

SEQ ID NO: 1199 - protein, 128 aa, Homo sapiens
QVQLVQSGAEVRPPGASVKVSCKASGYTFTAYDMHWVRQAPGQGLEWMGRVNPNNGATKVAEKFRGRVSMTTDTSITTAYMDIHGLTSDDTAVYFCARDRGDHFYYYAMDTWGRGTTVSVSSASTNGP

SEQ ID NO: 1200 - protein, 122 aa, Homo sapiens; identical to SEQ ID NO: 1174

SEQ ID NO: 1201 - protein, 146 aa, Homo sapiens
QVQLVQSGADVKEPGASLKVSCKASGHTFAAYYVHWVRQAPGQGLEWMGWIQPNSGVTKNAQTFRGRLTMTRDTSINTVYMELSRLRFDDTALYYCTERLREWGQGSLVTVSSASTKGPSGLPPGRPAPGRTSESTAALGCLVKDY

SEQ ID NO: 1202 - protein, 122 aa, Homo sapiens
QVQLVQSGAEVKKPGASVKVSCGASGYTFSNYYIHWLRQAPGQGLEWMAWINPSGGATIYAENFQGRVTVTRDTSMETVYMELNSLTSGDTAVYYCARDATPITTEFDFWGQGTLITVSSRL

SEQ ID NO: 1203 - protein, 118 aa, Homo sapiens
QVQLVQSGADVKKPGASVKVSCKASGYNFITYYIHLVRQAPGQGLEWMGCINPNSGGTNYAQRFQDKVSMTRDTSISTAYMELRRLISDDTAIYFVSLHMVSRTWGQGTLVTVSVTPP

SEQ ID NO: 1204 - protein, 165 aa, Homo sapiens
QVQLVQSGAEVRPPGASVKVSCKASGYTFTAYDMHWVRQAPGQGLEWMGRVNPNNGATKVAEKFRGRVSMTTDTSITTAYMDIHGLTSDDTAVYFCARDRGDHFYYYAMDTWGRGTTVSVSSASTKGPSVFPLAPSSKSTSGGTAALGCLVKDYFPEPVTVSWNS

SEQ ID NO: 1205 - protein, 120 aa, Homo sapiens
QVQLVQSGAEVKKPGASVKVSCGASGYTFSNYYIHWLRQAPGQGLEWMAWINPSGGATIYAENFQGRVTVTRDTSMETVYMELNSLTSGDTAVYYCARDATPITTEFDFWGQGTLITVSS

SEQ ID NO: 1206 - protein, 138 aa, Homo sapiens
QVQLVQSGAEVRPPGASVKVSCKASGYTFTAYDMHWVRQAPGQGLEWMGRINPNNGATKVAEKFRGRVSMTTDTSITTAYMDIHGLTSDDTAVYFCARDRGDHFYYYAMDTWGRGTTVSVSSASTKAHRSSPRPPSSN

SEQ ID NO: 1207 - protein, 147 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSASTKGPSVFPWHPPPRRTSGAQQPWLPGQGL

SEQ ID NO: 1208 - protein, 128 aa, Homo sapiens
QVQLVQSGAEVRPPGASVKVSCKASGYTFTAYDMHWVRQAPGQGLEWMGRVNPNNGATKVAEKFRGRVSMTTDTSITTAYMDIHGLTSDDTAVYFCARDRGDHFYYYAMDTWGRGTTVSVSSRLHQRA

SEQ ID NO: 1209 - protein, 119 aa, Homo sapiens
QVQLVQSGADVKEPGASLKVSCKASGHTFAAYYVHWVRQAPGQGLEWMGWIQPNSGVTKDAQTFRGRLTMTRDTSINTVYMELSRLRFDDTALYYCTERLREWGQGSLVTVSSRLHQRA

SEQ ID NO: 1210 - protein, 122 aa, Homo sapiens
QVQLVQSGTEVKKPGASLKVSCKASGYTFIDYYIHWVRQVPGQRLEWMGWINPKTTGALYADNFQGRVTMTSDTSINTVYMEVTRLTSDDTALYYCAREGHCGSTNCLFDFWGQGTLVTVSS

SEQ ID NO: 1211 - protein, 119 aa, Homo sapiens
QVQLVQSGAEVKKPGASVKVSCKASGYIFAGYYMEWVRQTPGQGLEWMGWIDPSGGATIYAEAFEGRVTVTTDTSMKTVYMELESLTSGDTAMYFCARDATPITTEFDYWGQGTLITVS

SEQ ID NO: 1212 - protein, 119 aa, Homo sapiens
QVQLVQSGADVKEPGASLKVSCKASGHTFAAYYVHWVRQAPGQGLEWMGWIQPNSGVTKNAQTFRGRLTMTRDTSINTVYMELSRLRFDDTALYYCTERLREWGQGSLVTVSSASTNGP

SEQ ID NO: 1213 - protein, 146 aa, Homo sapiens
QVQLVQSGSEVRKPGASVKVSCKTSGYTFIDYYIHWVRQAPGQGLQWMGWVNCNSGDTFYGQRFQGRVTMTRDTSNNTVYMETEQAEFRRHGRVLLWESESPGVWGKGTTVIVSSASTKGPSVFPLATLLQDAPRRGTSGPGLPGQ

SEQ ID NO: 1214 - protein, 126 aa, Homo sapiens
QVQLVQSGPEVKKPGASVKVSCKASGYTRNTYYVHWVRQAPGQGLEWMGWINPNSGGTNYAQKFQGRLTITTDELRTTAYMELSSLKSEDTAVYYCARNTDSVATSLYSLGVWGQGTVVTVSSAST

SEQ ID NO: 1215 - protein, 165 aa, Homo sapiens
QVQLVQSGTEVKKPGASLKVSCKASGYTFIDYYIHWVRQVPGQRLEWMGWINPKTTGALYADNFQGRVTMTSDTSINTVYMEVTRLTSDDTALYYCAREGHCGSTNCFFDFWGQGTLVTVSSASTKGPSVFPLGTLLQDAPLGHSGPGLPGQGLLPRTGDGVVEL

SEQ ID NO: 1216 - protein, 119 aa, Homo sapiens
QVQLVQSGAEVKKSGASVKVSCKTSGYTFTSYDINWVRQVTGQGLEWMGWMNPNSGGTNYAQRFQDKVSMTRDTSISTAYMELRRLISDDTAIYFCLTALDGVAYWGQGTLVTVSSAST

SEQ ID NO: 1217 - protein, 122 aa, Homo sapiens
QVQLVQSGADVKKPGASVKVSCRPLDITSSLTIYIGCDRPPGQGLEWMGCINPNSGGTNYAQRFQDKVSMTRDTSISTAYMELRRLISDDTAIYFCLTALDGVAYWGQGTLVTVSSASTNGP

SEQ ID NO: 1218 - protein, 123 aa, Homo sapiens
QVQLVQSGTDVRKPGASVKVSCKASGYTFTDYYIHWVRQAPGQRLEWMGWFNPNTGGAHYGLDYQGRVTMTGDTSMTTVYMELTRLASDDTAIYYCAREGLCRTTSCQFDYWGQGTLVTVFSR

SEQ ID NO: 1219 - protein, 117 aa, Homo sapiens
QVQLVQSGADVKKPGASVKVSCKASGYNFITYYIHWVRRAPGQGLEWMGCINPNSGGTNYAQRFQDKVSMTRDTSISTAYMELRRLISDDTAIYFCLTALDGVAYWGQGTLVTVSSR

SEQ ID NO: 1220 - protein, 122 aa, Homo sapiens
QVQLVQFGADMKKPGSSVKVTCKASGDGFTSYAVSWVRQAPGQGLEWMGWINPNRGGTKYAQKFQGRVTMTRDTAVNTAYMELNSLRSDDTAVYYCARLQSLSGFYSNADYWGQGTLVTVSS

SEQ ID NO: 1221 - protein, 122 aa, Homo sapiens
QVQLEQSGAEVKKPGASVMLSCKTSGYTFIDYYIYWVRLAPGRGLQWMGWMNPNRGGTKYAETFRDRVTMTRDTSVSTAYMELNNLRSDDTAVYYCARLQSLHGLYSNADYWGQGTLVTVSS

SEQ ID NO: 1222 - protein, 135 aa, Homo sapiens
QVQLVQSGADVKKPGASVKVSCKASGYNFITYYIHWVRQAPGQGLEWMGCINPNSGGTNYAQRFQDKVSMTKDTSISTAYMELRRLISDDTAIYFCLTALDGVAYWGQGTLVTVSSASTNGPTRSSPSATLPPTT

SEQ ID NO: 1223 - protein, 116 aa, Homo sapiens
QVQLVQSGADVKKPGASVKVSCKASGYNFITYYIHWVRRAPGQGLEWMGCINPNSGGTNYAQRFQDKVSMTRDTSISTAYMELRRLISDDTAIYFCLTALDGVAYWGQGTLVTVSS

SEQ ID NO: 1224 - protein, 122 aa, Homo sapiens
QVQLVQSGTDVRKPGASVRVSCKASGYTFTDYYIHWVRQAPGQRLEWMGWFNPNTGGAHYGLDYQGRVTMTGDTSITTVYMELTRLASDDTAIYYCAREGLCGTTSCQFDFWGQGTLVTVFS

SEQ ID NO: 1225 - protein, 124 aa, Homo sapiens
QVQLVQSGAEVKKPGASVKVSCRASGYRFTGYYVHWVRQAPGEGLEWMGINPNDGNTVYSQKYQGRVSMTWDMSIYTAYMEMSRLTSDDTAVYYCASPSPALGYFSYYMDVWGKGPRSSSSSRL

SEQ ID NO: 1226 - protein, 116 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSS

SEQ ID NO: 1227 - protein, 119 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSRLH

SEQ ID NO: 1228 - protein, 116 aa, Homo sapiens; identical to SEQ ID NO: 1226

SEQ ID NO: 1229 - protein, 122 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSRLHQRP

SEQ ID NO: 1230 - protein, 122 aa, Homo sapiens
QVQLVQSGTDVRKPGASVKVSCKASGYTFTDYYIHWVRQAPGQRLEWMGWFNPNTGGAHYGLDYQGRVTMTGDTSMTTVYMELTRLASDDTAIYYCAREDFVELPAANLTTWGQGTRGHRLL

SEQ ID NO: 1231 - protein, 116 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTRGHRLL

SEQ ID NO: 1232 - protein, 122 aa, Homo sapiens
QVQLVQSGAELKKPGASVKVSCKASGYTFTAFYIHWVRQAPGQGLEWMGWISPDSGNTKYVERFQGGVTMTRDTSTNTAYMELSRLGPDDTAVYYCMRINRGAYYFEYWGQGTLVTVSSAST

SEQ ID NO: 1233 - protein, 116 aa, Homo sapiens
QVQLVQSGADVKKPGASVRVSCKASGYNFITYYIHWVRQAPGQGLEWMGCINPNSGGTNYAQRFQDKVSMTRDTSISTAYMELRRLISDDTAIYFCLTALDGVAYWGQGTLVTVSS

SEQ ID NO: 1234 - protein, 110 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGT

SEQ ID NO: 1235 - protein, 120 aa, Homo sapiens
QVQLVQSGAEVKKPGASVKVSCKASGYIFSGHYMNWVRQAPGQGLEWMGWINPASGGTRYAQRFQDKVSMTRDTSISTAYMELRRLISDDTAIYFCLTALDGVAYWGQGTLVTVSSRLHQ

SEQ ID NO: 1236 - protein, 121 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSRLHQR

SEQ ID NO: 1237 - protein, 119 aa, Homo sapiens; identical to SEQ ID NO: 1227

SEQ ID NO: 1238 - protein, 116 aa, Homo sapiens; identical to SEQ ID NO: 1233

SEQ ID NO: 1239 - protein, 125 aa, Homo sapiens
QVQLVQSGTDVRKPGASVKVSCKASGYTFTDYYIHWVRQAPGQRLEWMGWFNPNTGGAHYGLDYQGRVTMTGDTSMTTVYMELTRLASDDTAIYYCAREGLCRTTSCQFDYWGQGTLVTVFSAST

SEQ ID NO: 1240 - protein, 119 aa, Homo sapiens
QVQLVQSGTEVKKPGASVMVTCKASGYSFNDYYVNWVRQAPGQGLEWMGWINPKTGDTNYARKFQGRVSMTRDTFINTAYIDLNKLKSDDTAVYYCAIGSGQPWLLMSWGRGTVGHRLF

SEQ ID NO: 1241 - protein, 122 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSRLHQRA

SEQ ID NO: 1242 - protein, 134 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSASTKGPSVFPLATLLQRR

SEQ ID NO: 1243 - protein, 116 aa, Homo sapiens; identical to SEQ ID NO: 1226

SEQ ID NO: 1244 - protein, 117 aa, Homo sapiens
QVQLVQSGADVKKPGASVRVSCKASGYNFITYYIHWVRQAPGQGLEWMGCINPNSGGTNYAQRFQDKVSMTRDTSISTAYMELRRLISDDTAIYFCLTALDGVAYWGQGTRGHRLLT

SEQ ID NO: 1245 - protein, 122 aa, Homo sapiens
QVQLVQSGTDVRKPGASVKVSCKASGYTFTDYYIHWVRQAPGQRLEWMGWFNPNTGGAHYGLDYQGRVTMTGDTSMTTVYMELTRLASDDTAIYYCAREGLCRTTSCQFDYWGQGTLVTVFS

SEQ ID NO: 1246 - protein, 131 aa, Homo sapiens
QVQLVQSGTEVKKPGASVMVTCKASGYSFNDYYVNWVRQAPGQGLEWMGWINPKTGDTNYARKFQGRVSMTRDTFINTAYIDLNKLKSDDTAVYYCAIGSGQPWALDVWGRGTLVTVSSASTRPSVSPAPA

SEQ ID NO: 1247 - protein, 121 aa, Homo sapiens
QVQLVQSGTDVRKPGASVKVSCKASGYTFTDYYIHWVRQAPGQRLEWMGWFNPNTGGAHYGLDYQGRVTMTGDTSMTTVYMELTRLASDDTAIYYCAREGLELPAANLTTWGQGTLVTVFS

SEQ ID NO: 1248 - protein, 119 aa, Homo sapiens; identical to SEQ ID NO: 1227

SEQ ID NO: 1249 - protein, 124 aa, Homo sapiens
QVQLVQSGTDVRKPGASVKVSCKASGYTFTDYYIHWVRQAPGQRLEWMGWFNPNTGGAHYGLDYQGRVTMTGDTSITTVYMELTRLASDDTAIYYCAREGLELPAANLTSWGQGTRGHRLLSLH

SEQ ID NO: 1250 - protein, 114 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTV

SEQ ID NO: 1251 - protein, 116 aa, Homo sapiens; identical to SEQ ID NO: 1231

SEQ ID NO: 1252 - protein, 118 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSRL

SEQ ID NO: 1253 - protein, 134 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSASTKVHRSFPLGHPPPTT

SEQ ID NO: 1254 - protein, 130 aa, Homo sapiens
QVQLVQSGADVKKPGASVRVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSRLHQRAQSGPSPVG

SEQ ID NO: 1255 - protein, 117 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSR

SEQ ID NO: 1256 - protein, 137 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFCLTALDGVAYWGQGTLVTVSSRLHQRAHPVLPPRPPSSNDAT

SEQ ID NO: 1257 - protein, 121 aa, Homo sapiens
QVQLVQSGAEVKKPGASVMVSCKASGYTFTDYYIYWVRQAPGQGLEWMGWINPNRGGTKYAQKFQGRSPPGRRPSTRAYLELNSLKSDDTAVYYCARLQSLHGFYSNADYWGQGTLVHRLL

SEQ ID NO: 1258 - protein, 146 aa, Homo sapiens
QVQLVQSGAEVKKPGASVKVSCRASGYRFTGYYVHWVRQAPGEGLEWMGWINPNDGNTVYSQKYQGRVSMTWDMSIYTAYMEMSRLTSDDTAVCYCARDPSPTPYYYDSSGYLSGGMDVWGQGTTVTVSVRECIRPTFSPRLLDFP

SEQ ID NO: 1259 - protein, 128 aa, Homo sapiens
QVQLVQSVSEIKKLGASVKVSCKASGYPFTNYFIHWVRQAPGQGLEWMAWINPHSGETHYAQKFQGRVTLTRDTSISTAYMDVSGLRSDDTALYYCARGWTMVQLPIATRYYYYMDVWGKGTTVIVSS

SEQ ID NO: 1260 - protein, 145 aa, Homo sapiens
QVQLVQSGTDVRKPGASVKVSCKASGYTFTDYYIHWVRQAPGQRLEWMGWFNPNTGGAHYGLDYQGRVTMTGDTSMTTVYMELTRLASDDTAIYYCAREGLCRTTSCQFDYWGQGTLVTVFSRLHQRPIRSSPSATLLPTTHLVG

SEQ ID NO: 1261 - protein, 125 aa, Homo sapiens
QVQLVQSGTDVRKPGASVKVSCKASGYTFTDYYIHWVRQAPGQRLEWMGWFNPNTGGAHYGLDYQGRVTMTGDTSITTVYMELTRLASDDTAIYYCAREGLCRTTSCQFDFWGQGTLVTVFSRLH

SEQ ID NO: 1262 - protein, 116 aa, Homo sapiens; identical to SEQ ID NO: 1226

SEQ ID NO: 1263 - protein, 122 aa, Homo sapiens; identical to SEQ ID NO: 1245

SEQ ID NO: 1264 - protein, 121 aa, Homo sapiens
QVQLVQSGTDVRKPGASVKVSCKASGYTFTDYYIHWVRQAPGQRLEWMEWFNPNTGGAHYGLDYQGRVTITTDESTSTAYMELSSLRSEDTAVYYCARVRGRNSGYESMDVWGQGTTVTVS

SEQ ID NO: 1265 - protein, 122 aa, Homo sapiens
QVQLEQSGPEVKKPGASVMVSCKASGYNFIDYYMYWVRQAPGQGPEWMGWINSNRGGTKYAQKFQGRITMTRDTAVSTAYLELNTLRSDDTAVYYCARLQSLHGLYSNADYWGQGTLVTVSS

SEQ ID NO: 1266 - protein, 122 aa, Homo sapiens
QVQLVQSGAEVKKPGASVKVSCKTSGYSFSDYHVHWVRQAPGQGLDWMGWINQNSGGATYAQKFQGRIAMTRDMSISTVFLELSSLRFDDTAIYYCARAQRPVADALELDHWGQGTRGQRLV

SEQ ID NO: 1267 - protein, 110 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAILFCLTALDGVAYWGQGT

SEQ ID NO: 1268 - protein, 138 aa, Homo sapiens
QVQLLQSGAEVKKPGASVMVSCKASGYTFIDYYIYWVRQAPGQGPEWMGWINTNRGGTKYTQKFQGRVTLTRDTAVTTAYLELNSLRSDDTAVYYCARLQSLHGLYSNADYWGQGTLVTVSSASTNGPSVFPLGHPPP

SEQ ID NO: 1269 - protein, 138 aa, Homo sapiens
QVQLVQSGAEVKKPGASVKVSCKASGYTFTAFYLHWVRQAPGRGLEWMGWINPINGGTIYSENFEGRVILTRDTSTSTAYMELSGLRSDDSAVYFCARDAIPVTTEFDFWGQGTLVSVSQPPPRPIRSSPVGHPPPTT

SEQ ID NO: 1270 - protein, 124 aa, Homo sapiens
QVQLVQSGPEVKKPGASVKVSCKASGYTFTDYYIYWVRQTPGQGLEWMGWINPNRGGTKYAQKMQGRVSMTRDTSINTVYMELSGLTSDDTVLLLLCEITKSLMVTTPMLYFWGQGTLVTVSSR

SEQ ID NO: 1271 - protein, 122 aa, Homo sapiens
QVQLVQSGPEVKKPGASVKVSCKASGYTFTDYYIYWVRQTPGQGLEWMGWINPNRGGTKYAQKMQGRVSMTRDTSINTVYMELSGLTSDDTAFYYCARLQSLNGYYSNADFWGQGTLVTVSS

SEQ ID NO: 1272 - protein, 135 aa, Homo sapiens
QVQLVQSGAEVKKPGASVMLSCKTSGYNFIDYYIYWVRLAPGRGLQWMGWINPNRGGTKYAETFRDRLTMTRDTSVSTAYMELNNLRSDDTAVYYCARLQSLHGLYSNADYWGQGTLVTVSSASTNGPTRSFPLG

SEQ ID NO: 1273 - protein, 122 aa, Homo sapiens
QVQLVQSGAEVKKPGSSVKVSCKASGYTFTDFYIHWVRQAPWTTSVGGMVQSHWWRTLWTGLSGQSHHDRGHVHQYSLHGTAQAGIRHGHLLLCERGTLYHQLPILTSWGQGALVTVSSRLH

SEQ ID NO: 1274 - protein, 122 aa, Homo sapiens; identical to SEQ ID NO: 1271

SEQ ID NO: 1275 - protein, 130 aa, Homo sapiens
QVQLVQSGAEVKKPGASVKVSCKASRYTVTGYFIHWVRQAPGQGLEWMGWIKPNSESTNYAQKFRGRVTMTGDMSINTVYMELRRLGSDDTAVYYCASCDRRGGLATMCEGGATTLWTSWGQGTTVIVSS

SEQ ID NO: 1276 - protein, 121 aa, Homo sapiens
QVQLVQSGAEVKKPGASVRVSCKASGYTFTDYFVHWVRQTPGQNFEWMGWTNVNTGGTKYAPKFQGRVTMTRDTSNSTAYIELSGLTSDDTAVYYCTRDELFRVDDAFDLWGQGTRGHRLF

SEQ ID NO: 1277 - protein, 137 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSASTKGPSVLPPRPPSS

SEQ ID NO: 1278 - protein, 124 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAIYYCTRDELFRVDDAFDMWGQGTLVTVSSAST

SEQ ID NO: 1279 - protein, 140 aa, Homo sapiens
QVQLVQSGPEVKKPGASVKVSCKASGYTFTDYYIYWVRQAPGQGLEWMGWINPNRGGTKYAQKMQGRVSMTRDTSINTVYMELSGLTSDDTAFYYCARLQSLNGYYSNADFWGQGTLVTVSSASTKGPSVLPPRPPSSND

SEQ ID NO: 1280 - protein, 124 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSAST

SEQ ID NO: 1281 - protein, 137 aa, Homo sapiens
QVQLVQSGAEVKKPGASVKVSCKASGYTFTAFYLHWVRQAPGRGLEWMGWINPINGGTIYSENFEGRVILTRDTSTSTAYMELSGLRSDDSAVYFCARDAIPVTTEFDFWGQGTLVSVSQPPPRPIGLPPRPPSSND

SEQ ID NO: 1282 - protein, 121 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAIYYCTRDELFRVDDAFDMWGQGTLVTVSS

SEQ ID NO: 1283 - protein, 141 aa, Homo sapiens
QVQLVQSGAEVKKPGASVKVSCKASGYTLTSYGISWVRQAPGQGPEWLGWINPKSGDTNYAQKFQGRVMLTRDTSITTVHMEVNRLRSDDTAMYYCARAPFVQDSGYDWVFGHWGQGTLVTVSSGSASAPTLFPSSPLRIP

SEQ ID NO: 1284 - protein, 108 aa, Homo sapiens
QVQLVQSGADVKKPGASVKVSCKASGYNFITYYIHWVRQAPGQGLEWMGCINPNSGGTNYAQRFQDKVSMTRDTSISTAYMELRRLISDDTAIYFVSLHMVSRTWGQG

SEQ ID NO: 1285 - protein, 151 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSASTKAHPVFPLATLLQDAPRGAQQPWAAWS

SEQ ID NO: 1286 - protein, 121 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTRGDRLF

SEQ ID NO: 1287 - protein, 127 aa, Homo sapiens
QVQLVQSGAEVKKRGASVKVSCKASGNFFTGYNIHWVRQASGQGLEWMGWINPDNGATKYAQGFQGRVTMTRDTSIKTTYMELSRLTSDDTAVYYCTRAIGSGSYYNGEEKHYFLYWGQGTLVTVSS

SEQ ID NO: 1288 - protein, 127 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSASTNGP

SEQ ID NO: 1289 - protein, 121 aa, Homo sapiens
QVQLVQFGGEVKKPGSSVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTRGHRLF

SEQ ID NO: 1290 - protein, 121 aa, Homo sapiens
QVQLVQSGAEVKKPGASVKVSCKASGYTFTDFYIHWVRQAPGQRLEWVGWYNPNTGGAHSGLDFQGRVTMTGDTSISTVYMELPRLASDDTAIYYCARERMATGTAISWGRGTLVTVSSRL

SEQ ID NO: 1291 - protein, 122 aa, Homo sapiens
QVQLVQSGAEVRKPGASVKISCQTSGYTFSDYFLHWVRQAPGQGLEWMAWINPTNGDTNFAQTFQGGVTVTRDTSISTVYMELSSLKSDDTAVYFCARGVRRYSGSWYLGYWGQGTLVTVSS

SEQ ID NO: 1292 - protein, 125 aa, Homo sapiens
QVQLVQSGAEVKKPGASVKVSCKASGYTFTDYFVHWVRQAPGQNFEWMGWTNVNTGGTKYAPKFQGRVIMTRDTSISTAYIELSGLTSDDTAVYYCTRDELFRVDDAFDMWGQGTLVTVSSRLHQ

SEQ ID NO: 1293 - protein, 120 aa, Homo sapiens
QVQLVQSGAEVKKPGASVRVSCKASGYTFTDYFVHWVRQAPGQNFEWMGWTNVNTGGTKYAPKFQGRVTMTRDTSISTAYIELSGLTSDDTAIYYCTRDELFRVDDAFDMWGQGHWSPSL

SEQ ID NO: 1294 - protein, 122 aa, Homo sapiens
QVQLVQSGAEVKKPGASVKVSCKASGYTFTAYYLNWVRQAPGQGLEWVGWINPNSGVTIYAEAFEGRVTVTTDTSMKTVYMELESLTSGDTAMYFCARDATPITTEFDYWGQGTLITVSSRL

SEQ ID NO: 1295 - protein, 126 aa, Homo sapiens
QVQLVQSGPEVKKPGASVKVSCKASGYTRNTYYVHWVRQAPGQGLEWMGWINPNSGGTNYAHKFQSRVTMTRDTSISTFYMELSGLTSDDTAIYYCATDFDGGNFLYYFDSWGPGNGAHRLLSLHQ

SEQ ID NO: 1296 - protein, 120 aa, Homo sapiens
QVQLVQSGAEVKKPGASVKVSCKASGYTFTDYYIHWVRQAPGQRLEWMGWFNPNTGGAHYGLDYQGRVTMTGDTSMTTVYMELTRLASDDTAIYYCAREGLCRTTSCQFDYWGQGTLVTV

SEQ ID NO: 1297 - protein, 122 aa, Homo sapiens
QVQLVQSGAEVKKPGASVMVSCKASGYTFIDYYIYWVRQAPGQGPEWMGWINTNRGGTKYAQKFQGRATLTRDTAVTTAYLELNSLRSDDTAVYYCARLQSLHGLYSNADYWGQGTLVTVSS

SEQ ID NO: 1298 - protein, 125 aa, Homo sapiens
QVQLVQSGPEVKKPGASVMVSCKASGYTFIDYYIYWVRQAPGQGLEWMGWINPNRGGTKYAQNFQGRVTMTRDTAVSTAYMELNSVRSDDTAVYYLRDYKAFMGFTLTLTTWGQGTLGHRLLTPP

SEQ ID NO: 1299 - protein, 120 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAIYYCTRDELFRVDDVLWWGQGTRGHRLF

SEQ ID NO: 1300 - protein, 138 aa, Homo sapiens
QVQLVQSGPEVKKPGASVMVSCKASGYTFIDYYIYWVRQAPGQGLEWMGWINPNRGGTKYAQNFQGRITMTRDTAVSTAYMELNSLRFDDTAVYYCARLQSLHGLYSNADYWGQGTLVTVSSGSASAPTLFPVSSENS

SEQ ID NO: 1301 - protein, 115 aa, Homo sapiens
QVQLVQSGAEVKKPGASVKVSCKASGYTFTDYFVHRVRQAPGQNFEWMGWTNVNTGGTNYAPRFQGRVTMTRDTSISTAYIELSGLTSDDTAVYYCTRDELFRVDDAFDMWGQGT

SEQ ID NO: 1302 - protein, 125 aa, Homo sapiens
QVQLVQSGPEVKKPGASVMVSCKASGYNFIDYYMYWVRQAPGQGPEWMGWINSNRGGTKYAQKFQGRITMTRDTAVSTAYLELNTLRSDDTAVYYCARLQSLHGLYSNADYWGQGTLVTVSSRLH

SEQ ID NO: 1303 - protein, 125 aa, Homo sapiens
QVQLVQSGAEVRKPGASVKVSCKASGYTFTDYFIHWVRQAPGQGLEWMGRINPKSGGTNYAQKFQISVTMTWDTSISTAYIEVNRLTSDDTAVYYCARGDRLAPYNSRVRYFDLWGRGTLVTVSS

SEQ ID NO: 1304 - protein, 142 aa, Homo sapiens
QVQLEQSGPEVKKPGASVMVSCKASGYNFIDYYMYWVRQAPGQGPEWMGWINSNRGGTKYAQKFQGRITMTRDTAVSTAYLELNTLRSDDTAVYYCARESIVVVVAASTYSYGMDVWGQGTTVTVSSGSASAPTLFPLVLLR

SEQ ID NO: 1305 - protein, 124 aa, Homo sapiens
QVQLVQSGAEVKKPGASVKVSCKASGYTFTDYFVHWVRQAPGQNLEWMGWTNVNTGGTNYAPKFQGRVTMTRDTSISTAYIELSGLTSDDTAVYYCTRDELFRVDDAFDMWGQGTLVTVSSAST

SEQ ID NO: 1306 - protein, 128 aa, Homo sapiens
QVQLVQSGAEVKKPGASVKVSCKASGYSFSDFYIHWVRQAPGQRLEWMGWFNPNTGGAHSGLDFQDRVTMTGDTSISTAYMELPRLASDDTAIYYCAREGHCPTTSCHFDFWGQGALVTVSSASTNGP

SEQ ID NO: 1307 - protein, 122 aa, Homo sapiens
QVQLVQSGAEVKKPGASVNVSCKASEYTFTTYYLHWVRQAPGQGLEWVGWINPKDGGTKYAQKFQGRVTMTRDTSITTAYMELSSLKSDDTAMYFCARDLGHLSSAGTYAFWGQGTLVTVSS

SEQ ID NO: 1308 - protein, 127 aa, Homo sapiens
QVQLVQSGAEVKKRGASVKVSCKASGNFFTGYNIHWVRQASGQGLEWMGWINPDNGATKYAQEFQGRVTMTRDTSIKTTYMELSRLTSDDTAVYYCTRAIGSGSYYNGEEKHYFLYWGQGTLVTVSS

SEQ ID NO: 1309 - protein, 125 aa, Homo sapiens
QVQLVQSGAEVKKPGASVRVSCKASGYTFTDYFVHWVRQAPGQNFEWMGWTNVNTGGTKYAPKFQGRVTMTRDTSNSTAYIELSGLTSDDTAVYYCTRDELFRVDDAFDLWGQGTLVTVSSASTN

SEQ ID NO: 1310 - protein, 137 aa, Homo sapiens
QVQLVQSGAEVKKPGASVKVSCKASGYTFTDYFVHWVRQAPGQNFEWMGWTNVNTGGTNYAPKFQGRVTMTRDTSISTAYIELSGLTSDDTAVYYCTRDELFRVDDAFDMWGQGTLVTVSSASTNGHRLPLGHPPPR

SEQ ID NO: 1311 - protein, 142 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAIYYCTRDELFRVDDAFDMWGQGTLVTVSSASTNGPTPVFPLGRPASNDAP

SEQ ID NO: 1312 - protein, 147 aa, Homo sapiens
QVQLVQSGTDVRKPGASVRVSCKASGYNFTGYFIHWVRQGPGQGLEWMGWVNPNTGGAKYAQKFQGRVTMTRDTSIRTAYMELSSLKPGDTAVYYCARDPQDGTTWYTHWGQGTLVTVSSASTKGPSVFPWHPPPRAPLGAQRPWAA

SEQ ID NO: 1313 - protein, 125 aa, Homo sapiens
QVQLVQSGAEVRKPGASLRVSCKASGYIFSDYHLHWVRQAPGQGLEWMGWINHNSGGATYAQKFQGRIAMTRDTSIDTAFLELSRLRFDDTAVYYCARAQRPVADALELDHWGQGTLVSVSSAST

SEQ ID NO: 1314 - protein, 122 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAIYYCTRDELFRVDDAFDMWGQGTLVTVSSA

SEQ ID NO: 1315 - protein, 122 aa, Homo sapiens
QVQLVQSGAEVRKPGASLRVSCKASGYIFSDYHLHWVRQAPGQGLEWMGWINHNSGGATYAQKFQGRIAMTRDTSIDTAFLELSRLRFDDTAVYYCARAQRPVADALELDHWGQGTLVSVSS

SEQ ID NO: 1316 - protein, 122 aa, Homo sapiens
QVQLVQSGTEVKKPGASVMVTCKASGYSFNDYYVNWVRQAPGQGLEWMGWINPKTGDTNYARKFQGRVSMTRDTFITTAYLELNSLTSDDTAVYYCVRGARGMPKGAFDIWGQGTLVIVSSA

SEQ ID NO: 1317 - protein, 143 aa, Homo sapiens
QVQLVQSGPEVKKPGASVMVSCKASGYTFIDYYIYWVRQAPGQGLEWMGWINPNRGGTKYAQNFQGRVTMTRDTAVSTAYMELNSVRSDDTAVYYCARLQSLHGLYSNADYWGQGTLVTVSSRLHQRAHPVLPPSATLLPTTP

SEQ ID NO: 1318 - protein, 121 aa, Homo sapiens
QVQLVQSGAEVKKPGASVKVSCKASGYTFTDYFVHWVRQAPGQNFEWMGWTNVNTVGTKYAPKFQGRVTMTRDTSISTAYIELSGLTSDDTAVYYCTRDELFRVDDAFDMWGQGTLVTVSS

SEQ ID NO: 1319 - protein, 126 aa, Homo sapiens
QVQLVQSGVEVKKPGASMKVSCKASGYNFTGYFIHWVRHGPGQGLEWMGWMNPNTGGAKYGQKFQGRVTMTRDTSIRTAYMELSSLKPGDTAVYYCARDPQDGTTWYTHWGQGTLVTVSSASTNGP

SEQ ID NO: 1320 - protein, 125 aa, Homo sapiens
QVQLVQSGAEVKKPGASVKVSCKASGYTFTDFYIHWVRQAPGQRLEWVGWYNPNTGGAHSGLDFQGRVTMTGDTSISTVYMELPRLASDDTAIYYCAREGHCSTTSCHFDFWGQGALVHRLLTPP

SEQ ID NO: 1321 - protein, 123 aa, Homo sapiens
QVQLVRSGAEMKKPGASVKVSCKTSGYTFTDYYFHWLRQAPWTRAVDGMARPHWWHKLCTKFSGQVAMTRDTSISTVYMELRRLRSDDTAVYYCVRDGGRRLGGSWYPNFDKWGPGNTYHRLL

SEQ ID NO: 1322 - protein, 126 aa, Homo sapiens
QVQLVQSGPEVKKPGASVMVSCKASGYTFIDYYIYWVRQAPGQGLEWMGWINPNRGGTKYAQNFQGRVTMTRDTAVSTAYMELNSVRSDDTAVYYCARLQSLHGLYSNADYWGQGTLAHRLLTPPP

SEQ ID NO: 1323 - protein, 158 aa, Homo sapiens
QVQLVQSGAEVRKPGASVKVSCKASGYTFTDYYIHWVRQVPGQGLEWIGWIHPNSGRATHTQKFQGRVTMTSGTSISTVYMELTGLTPDDTAVYYCARDNYRNNVWVLYTFDYWGQGTLVTVSSASTKGPSVFPLAPSSKSTSGAQQPWAAWSRTTSR

SEQ ID NO: 1324 - protein, 121 aa, Homo sapiens
QVQLVQSGAEVKKPGASVKVSCKASGYTFTDYFVHWVRQAPGQNFEWMGWTNVNTGGTNYAPKFQGRVTMTRDTSISTAYIELSGLTSDDTAVYYCTRDELFRVDDAFDMWGQGTRGHRLF

SEQ ID NO: 1325 - protein, 122 aa, Homo sapiens
QVQLVQSGPEVKKPGASVMVSCKASGYTFIDYYIYWVRQAPGQGLEWMGWINPNRGGTKYAQNFQGRVTMTRDTAVSTAYMELNSVRSDDTAVYYCARLQSLHGLYSNADYWGQGTLVTVSS

SEQ ID NO: 1326 - protein, 142 aa, Homo sapiens
QVQLVQSGPEVKKPGASVMVSCKASGYTFIDYYIYWVRLAPGQGLEWMGWINPNRGGTKYAQKFQGRITMTRDTAVSTAYMELTTLRSDDTAMYYCARLQSLHGLYSNADYWGQGTLVTVSSRPTRPLVSPRTLLHDAPRRG

SEQ ID NO: 1327 - protein, 142 aa, Homo sapiens
QVQLVQSGAEVRKPGASVKVSCKASGYTFTDYYIHWVRQVPGQGLEWIGWIHPNSGRATHTQKFQGRVTMTSGTSISTVYMELTGLTPDDTAVYYCARDNYRNNVWVLYTFDYWGQGTLVTVSSASTNGPIRSSPRPPSSND

SEQ ID NO: 1328 - protein, 124 aa, Homo sapiens
QVQLVQSGAEVKKPGASVKVSCKASGYTFTDYFVHWVRQAPGQNFEWMGWTNVNTGGTNYAPKFQGRVTMTRDTSISTAYIELSGLTSDDTAVYYCTRDELFRVDDAFDMWGQGTLVTVSSAST

SEQ ID NO: 1329 - protein, 124 aa, Homo sapiens
QVQLVQSGAEVRKPGASVKVSCKASGYTFTDYYIHWVRQVPGQGLEWIGWIHPNSGRATHTQKFQGRVTMTSGTSISTVYMELTGLTPDDTAVYYCARDNYRNNVWVLYTFDYWGQGTLVTVSS

SEQ ID NO: 1330 - protein, 142 aa, Homo sapiens
QVQLVQSGAEVRKPGASVKVSCKASGYTFTDYYIHWVRQVPGQGLEWIGWIHPNSGRATHTQKFQGRVTMTSGTSISTVYMELTGLTPDDTAVYYCARDNYRNNVWVLYTFDYWGQGTLVTVSSASTKGPSGLPPGHPPPTT

SEQ ID NO: 1331 - protein, 122 aa, Homo sapiens
QVQLVHSGAEVKKPGASVKVSCQTSGYTFSDYFLHWVRQAPGQGLEWMAWINPTNGDTNFAQTFQGRVTVTRDTSISTVYMELSSLKSDDTAVYFCARGVRRYSGSWYLGYWGQGTLVTVSS

SEQ ID NO: 1332 - protein, 122 aa, Homo sapiens
QVQLVQSGAEVKKPGASVKVSCKASGYTFIDYYIYWVRQAPGQGPEWMGWINTNRGGTKYAQKFQGRVTLTRDTAVTTAYLELNSLRSDDTAVYYCARLQSLHGLYSNADYWGQGTLVTVSS

SEQ ID NO: 1333 - protein, 116 aa, Homo sapiens
QVQLVQSGPEVKKPGASVMVSCKASGYTFIDYYIYWVRQAPGQGLEWMGWINPNRGGTKYAQNFQGRVTMTRDTAVSTAYMELNSVRSDDTAVYYCARLQSLHGLYSNADYWGQGT

SEQ ID NO: 1334 - protein, 122 aa, Homo sapiens
QVQLVQSGAEVKKPGASVMVSCKASGYTFIDYYIYWVRQAPGQGPEWMGWINTNRGGTKYAQKFQGRVTLTRDTAVTTAYLELNSLRSDDTAVYYCARLQSLHGLYSNADYWGQGTLVTVSS

SEQ ID NO: 1335 - protein, 127 aa, Homo sapiens
QVQLVQSGAEVKKPGASVKVSCKASGYTFTDYFVHWVRQAPGQNFEWMGWTQRQHWWHKLCTKVSGQGHHDQGHVHQHSLHTERPDIRHGRLYCTRDELFRVDDAFDMWGQGTLVTVSSASTKAHRS

SEQ ID NO: 1336 - protein, 125 aa, Homo sapiens
QVQLVQSGAEVKKPGASVKVSCKASGYTFSAYYLHWVRQAPGQGLEWMGCINPNSGATIYAPKFQGRVTLTTDTPISTTFMEMSGLTYGDTAVYYCSRDYAEILTDYYIVDYWGQGTLVTISSRL

SEQ ID NO: 1337 - protein, 125 aa, Homo sapiens
QVQLVQSGAEVKKPGASVKVSCKASGDIFSDYGVHWVRQAPGQGLEWMGWINHNSGGATYAQKFHGRVAMTRDTSISMAFMELSRLRFDDTAVYYCARAQRPVADALELDSWGQGTLVSVSSRLH

SEQ ID NO: 1338 - protein, 164 aa, Homo sapiens
QVQLVQSGAEVKKPGASVKVSCKASGYTFTDYFVHWVRQVPGQNFEWMGWTNVNTGGTNYAPKFQGRVTMTRDTSISTAYIELSGLTSDDTAVYYCTRDELFRVDDAFDMWGQGTLVTVSSASTKGPSAFPLAPSSKTHLWGTAALGCLVKDYFPEPVTVSWNS

SEQ ID NO: 1339 - protein, 128 aa, Homo sapiens
QVQLVQSGAEVKKPGASVMVSCKASGYTFIDYYIYWVRQAPGQGPEWMGWINTNRGGTKYAQKFQGRVTLTRDTAVTTAYLELNSLRSDDTAVYYCARLQSLHGLYSNADYWGQGRWSPSPQPPPTGP

SEQ ID NO: 1340 - protein, 129 aa, Homo sapiens
QVQLVQSGAEVKKPGASVKVSCQTSGYTSTGHYTHWVRQAPGQRPEWMGWMNPNSGGTTFAPKFQGRITMTRDTSTSTAYLEVRGLRADDTAVYYCARDYCSGGFCHYFFDSWGQGTLVTVSSASTNGP

SEQ ID NO: 1341 - protein, 122 aa, Homo sapiens
QVQLVQSGPEVKKPGASVMVSCKASGYTFIDYYIYWVRLAPGQGLEWMGWINPNRGGTKYAQKFQGRITMTRDTAVSTAYMELTTLRSDDTAMYYCARLQSLHGLYSNADYWGQGTLVTVSS

SEQ ID NO: 1342 - protein, 124 aa, Homo sapiens
QVQLVQSGAEVKKPGASVKVSCKASGYTFTDYFVHWVRQAPGQNFEWMGWTNVNTGGTKYAPKFQGRVTMTRDTSISTAHIELSGLTSDDTAVYYCTRDELFRVDDAFDMWGQGTLVTVSSAST

SEQ ID NO: 1343 - protein, 121 aa, Homo sapiens
QVQLVQSGADVKKPGASVKVSCKASGYTFTDYFVHWVRQVPGQNFEWMGWTNVNTGGTNYAPKFQGRVTMTRDTSISTAYIELSGLTSDDTAVYYCTRDELFRVDDAFDMWGQGTLVTVSS

SEQ ID NO: 1344 - protein, 141 aa, Homo sapiens
QVQLVQSGAEVKKPGASVKVSCKASGLTFIGYYMHWVRQAPGQGLEWMGWINPNNGNTNYAQKFRGRVTMARDTSISTAYMELRGLKFDDTSIYCCAISADFSGVSDYYYMGVWGKGTTVTVSSGVHPPNPFPSSSSRRIP

SEQ ID NO: 1345 - protein, 155 aa, Homo sapiens
QVQLVQSGAEVKKPGASVKVSCQTSGYTSTGHYTHWVRQAPGQRPEWMGWMNPNSGGTTFAPKFQGRITMTRDTSTSTAYLELRGLRADDTAVYYCARDYCSGGFCHYFFDSWGQGTLVTVSSASTKGPSVFPLAPSSNEHLWGTAALAAWSGLL

SEQ ID NO: 1346 - protein, 112 aa, Homo sapiens
QVQLVQSGAEVKKPGASMKVSCKASGYTFNDYYIQWVRQAPGQGLEWMGCINPQSDDTKYAQKFQGRVTMTRDTSTNTAYMELSGLTFDDTAMYYCLTAIDGIVYWGQGPLV

SEQ ID NO: 1347 - protein, 124 aa, Homo sapiens
QVQLVQSGAEVKKPGASVKVSCKASGYAFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSAST

SEQ ID NO: 1348 - protein, 133 aa, Homo sapiens
QVQLVQSGAEVKKPGASVKVSCQTSGYTSTGHYTHWVRQAPGQRPEWMGWMNPNSGGTTFAPKFQGRITMTRDTSTSTAYLEVRGLRADDTAVYYCARDYCSGGFCHYFFDSWGQGTLVTISSASTKAHRSSP

SEQ ID NO: 1349 - protein, 125 aa, Homo sapiens
QVQLVQSGAEVKKPGASVMVSCKASGYTFIDYYIYWVRQAPGQGPEWMGWINTNRGGTKYAQKFQGRVTLTRDTAVTTAYLELNSLRSDDTAVYYCARLQSLHGLYSNADYWGQGTLVTVSSAST

SEQ ID NO: 1350 - protein, 128 aa, Homo sapiens
QVQLVQSGAEVKKPGASVKVSCKASGYTFTTYYIHWVRQAPGQGLEWVGWFNPNSGGAHYGLDYQGRVTMTGDTSMTTVYMELTRLASDDTAIYYCAREGLCRTTSCQFDYWGQGTLVTVFSASTNGP

SEQ ID NO: 1351 - protein, 120 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKTRRHGRLYCARDPQDGTTWYTHWGQGTLVTVSS

SEQ ID NO: 1352 - protein, 124 aa, Homo sapiens
QVQLVQSGAEVKKPGASVKVSCKASGYSFTGYYIHWLRQTPGQGPEWMGWINPNTGGANYAPNFEGRVTMTRDTSTKTAYMELSRLRSDDTAFYYCAEGGVLLRGYYCFLLISWGPGNAGDRLL

SEQ ID NO: 1353 - protein, 125 aa, Homo sapiens
QVQLVQSGAEVKKPGASVKVSCKASGYRFIDYYIHWVRQAPGQGLDYMGWINPKSGDTNYVTKFQGRVTMTRDTSISTGYMEMTGLISDDTAVYYCAKTGGKYADYLDIDYWGQGTLVTVSSTST

SEQ ID NO: 1354 - protein, 138 aa, Homo sapiens
QVQLVQSGAEVKKPGASVKVSCKASGYTFTDYFVHWVRQAPGQNFEWMGWTNVNTGGTNYAPKFQGRVTMTRDTSISTAYIELSGLTSDDTAVYYCTRDELFRVDDAFDMWGQGTLVTVSSASTKAHRSSPWPPSSND

SEQ ID NO: 1355 - protein, 123 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKPGDTAVYHCARDPQDGTTWYTHWGQGHWSPSPQPPP

SEQ ID NO: 1356 - protein, 141 aa, Homo sapiens
QVQLVQSGAEVKKPGASVKVSCQASGYTFTDYYIHWVRQAPGQGLEWMGWINPNSGGTNYAQKFQGRLTITTDEYTNTAYMELSSLRSEDTAVYYCARAQDSGSGNLINWFDPWGQGTLVTVSSGSASAPTLFPSSPLRIP

SEQ ID NO: 1357 - protein, 122 aa, Homo sapiens
QVQLVQSGAEVRKPGASVKVSCKASGYSFSDFYIHWVRQAPGQRLEWMGWFNPNTGGAHSGLDFQDRVTMTGDTSISTAYMELPRLVSDDTAIYYCAREGHCPTTSCHFDFWGQGALVTVSS

SEQ ID NO: 1358 - protein, 124 aa, Homo sapiens
QVQLVQSGAEVKKPGASVKVSCKASGYTFTDYFVHWVRQAPGQNFEWMGWTNVNTGGTNYAPKFQGRVTMTRDTSISTAYIELSGLTSDDTAVYYCTRDELFRVDDAFDMWGQGTRGHRLFTPP

SEQ ID NO: 1359 - protein, 163 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSASTKAHRSSPWHPPPRAPLGHSSPGLPGQGLLPEPVTVSWNS

SEQ ID NO: 1360 - protein, 121 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSS

SEQ ID NO: 1361 - protein, 118 aa, Homo sapiens
QVQLVQSGAEMKKPGASVKVSCRASGYRFNDYYMHWLRQAPGQGPEWMGWINPKQWWHKIMHRGLRAGSPPGTGPSTQPTWTTGYLTTRPFTTVREDFSAVRGDIPSTLTSWGQGTLV

SEQ ID NO: 1362 - protein, 124 aa, Homo sapiens
QVQLVQSGAEVKKPGASVKVSCKASGLTFIGYYMHWVRQAPGQGLEWMGWINPNNGNTNYAQKFRGRVTMARDTSISTAYMELRGLKFDDTSIYYCAISADFSGVSDYYYMGVWGKGTAVTVSS

SEQ ID NO: 1363 - protein, 121 aa, Homo sapiens
QVQLVQSGAEVKKPGASVKVSCKASGYTFTDYFVHWVRQAPGQNFEWMGWTNVNTGGTNYAPKFQGRVTMTRDTSISTAYIELSGLTSDDTAVYYCTRDELFRVDDAFDMWGQGTLVTVSS

SEQ ID NO: 1364 - protein, 137 aa, Homo sapiens
QVQLVQSGAEVKKPGASVRVSCKASGYTFTDYFVHWVRQAPGQNFEWMGWTNVNTGGTKYAPKFQGRVTMTRDTSNSTAYIELSGLTSDDTAVYYCARDPQEGSSWYTHWGQGTLVTVSSASTNGPIGLPPWPPSSN

SEQ ID NO: 1365 - protein, 133 aa, Homo sapiens
QVQLVHSGAEVKKPGASVKVSCQTSGYTFSDYFLHWVRQAPGQGLEWMAWINPTNGDTNFAQTFQGRVTVTRDTSISTVYMELSSLKSDDTAVYFCARGVRRYSGSWYLGYWGQGTLVTVSSASTKGPSGLPP

SEQ ID NO: 1366 - protein, 122 aa, Homo sapiens
QVQLVQSGAEVKKPGASVKVSCKASGYSFSDYHLHWVRQAPGQGLEWMGWINHNGGGATYAQKFQGRVAMTRDTSISTVFMELSRLRFDDTAVYYCASSVGADFCFDYWGQGTLVTGLLREC

SEQ ID NO: 1367 - protein, 149 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSASTNGPSGLPPGRPASTDATSDEPRRRP

SEQ ID NO: 1368 - protein, 121 aa, Homo sapiens; identical to SEQ ID NO: 1360

SEQ ID NO: 1369 - protein, 118 aa, Homo sapiens
QVQLVHSGAEVKKPGASVKVSCQTSGYTFSDYFLHWVRQAPGQGLEWMAWINPTNGDTNFAQTFQGRVTVTRDTSISTVYMELSSLKSDDTAVYFCARGVRRYSGSWYLGYWGQGTLV

SEQ ID NO: 1370 - protein, 125 aa, Homo sapiens
QVQLVHSGAEVKKPGASVKVSCQTSGYTFSDYFLHWVRQAPGQGLEWMAWINPTNGDTNFAQTFQGRVTVTRDTSISTVYMELSSLKSDDTAVYFCARGVRRYSGSWYLGYWGQGTLVTVSSAST

SEQ ID NO: 1371 - protein, 115 aa, Homo sapiens
QVQLVQSGAEVKKPGASVMVSCKASGYTFIDYYIYWVRQAPGEGLEWMGWINPNRGGNKVCTEVSGPGHHDQGHGRQHGLYGTEQPEIRHGRLLLCETSEPWVFTLTLTTWGQGT

SEQ ID NO: 1372 - protein, 136 aa, Homo sapiens
QVQLVQSGAEVKKPGASVKVSCKASGYTFTDYFVHWVRQAPGQNFEWMGWTQRQHWWHKLCTKVSGQGHHDQGHVHQHSLHTERPDIRHGRLYCARGDYDYLWGNYRFEYWGQGTLVTVSSASTKGPSVFPLAPSS

SEQ ID NO: 1373 - protein, 122 aa, Homo sapiens
QVQLVQSGAEVKKPGASVKVSCKASGYRFIDYYIHWVRQAPGQGLDYMGWINPKSGDTNYVTKFQGRVTMTRDTSISTGYMEMTGLISDDTAVYYCAKTGGKYADYLDIDYWGQGTLVTVSS

SEQ ID NO: 1374 - protein, 125 aa, Homo sapiens; identical to SEQ ID NO: 1353

SEQ ID NO: 1375 - protein, 124 aa, Homo sapiens; identical to SEQ ID NO: 1328

SEQ ID NO: 1376 - protein, 122 aa, Homo sapiens; identical to SEQ ID NO: 1373

SEQ ID NO: 1377 - protein, 124 aa, Homo sapiens; identical to SEQ ID NO: 1280

SEQ ID NO: 1378 - protein, 126 aa, Homo sapiens
QVQLVQSGAEVKKPGASVKVSCKASGYRFIDYYIHWVRQAPGQGLDYMGWINPKSGDTNYVTKFQGRVTMTRDTSISTGYMEMTGLISDDTAVYYCAKTGGKYADYLDIDYWGQGTLVTVSSTSTN

SEQ ID NO: 1379 - protein, 121 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTRGHRLF

SEQ ID NO: 1380 - protein, 121 aa, Homo sapiens; identical to SEQ ID NO: 1360

SEQ ID NO: 1381 - protein, 127 aa, Homo sapiens
QVQLVQSGAEVRKPGASVKVSCKASGYIFTGHYMNWVREAPGQGLEWMGWINPDSGGTKYAEQFQGRVTTTRDTSINTVYMELSSLRSDDTAIYYCARLFVVVPVYFFRNNCLLISWGQGTTVTVSS

SEQ ID NO: 1382 - protein, 138 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSGSASAPTLFPSSPLRIP

SEQ ID NO: 1383 - protein, 140 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTLVTVSSASTNGPIGPSPVGHPPPTT

SEQ ID NO: 1384 - protein, 121 aa, Homo sapiens
QVQLLQSGAEVKKPGASVMVSCKASGYTFIDYYIYWVRQAPGQGLEWMGWINPNRGGTKYAQKFQGRVTLTRDTAVTTAYLEVNSLRSDDTAVYYCARLQSLHGFYSNADYWGQGRWSPSP

SEQ ID NO: 1385 - protein, 138 aa, Homo sapiens
QVQLVQSGAEVKKPGASVKVSCKASGYSFSDYHIHWVRQAPGQGLEWMGWINQNGGGATHVQKFQGRVAMTRDTSISTAFMELSRLRFDDTAIYYCARALRPVADALELDYWGRGNAGHRLVTPPPTGPVRSFPRRPP

SEQ ID NO: 1386 - protein, 138 aa, Homo sapiens
QVQLVQSGAEVKKPGASVKVSCKASGYTFTSYGISWVRQAPGQGLEWMGWINPNNDGTTYAHKFQGRVTVTRDTSISTAYMELSGLRSDDTAIYYCARAPYSALYFYMDVWGKGTTVTVSSGSASAPTLFPSSPLRIP

SEQ ID NO: 1387 - protein, 123 aa, Homo sapiens
QVQLVQSGAEVKKPGASVKVSCKASGYTFSAYYLHWVRQAPGQGLEWMGCINPNSGATIYAPKFQGRVTLTTDTSISTTFMEMSGLTYGDTAVYYCSRDHAEILTDYYIVDYWGQGTLVTVSS

SEQ ID NO: 1388 - protein, 133 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKPGDTAVYYCARDPQDGTTWYTHWGQGTLVTVSSASTKGPSGPSPVA

SEQ ID NO: 1389 - protein, 127 aa, Homo sapiens
QVQLVQSGAEVKKPGASVKVSCKASGYSFSDYHIHWVRQAPGQGLEWMGWINQNGGGATHVQKFQGRVAMTRDTSISTAFMELSRLRFDDTAIYYCARALRPVADALELDYWGQGTLVTVSSGSASA

SEQ ID NO: 1390 - protein, 122 aa, Homo sapiens
QVQLVQSGAEVKKPGASVKVSCKASGYSFSDYHIHWVRQAPGQGLEWMGWINQNGGGATHVQKFQGRVAMTRDTSISTAFMELSRLRFDDTAIYYCARALRPVADALELDYWGQGTLVTVSS

SEQ ID NO: 1391 - protein, 121 aa, Homo sapiens
QVQLLQSGAEVKKPGASVMVSCKASGYTFIDYYIYWVRQAPGQGLEWMGWINPNRGGTKYAQKFQGRVTLTRDTAVTTAYLEVNSLRSDDTAVYYCARLQSLHGFYNADYWGQGTLVTVSS

SEQ ID NO: 1392 - protein, 128 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKPGDTAVYYCARDPQDGTTWYTHWGQGTLVTVSSASTKAHRS

SEQ ID NO: 1393 - protein, 138 aa, Homo sapiens
QVQLVQSGAEVKKPGASVKVSCKISGYTFTKFYIHWVRQAPGQGLEWLGWINPNNGGTKSAQQFQGRVALTRDTSLSTAYIELSSLTSDDTAVYYCARGDYDYLWGNYRFEYWGQGTLVTVSSASTKAHRSSPWPPSL

SEQ ID NO: 1394 - protein, 141 aa, Homo sapiens
QVQLVQSGAEVKKPGASVKVSCKTSGYTFTDNYIHWVRQAPGQGLEWMGWINPNSGGSKSPQKFQGRVTMTRDTSVSTVYLELTRLKFDDTAIYYCTKDYGIVGSTLPEYFQHWGQGTLVTVSSRLHQRPIRSSPSATLLQ

SEQ ID NO: 1395 - protein, 142 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKPGDTAVYYCARDPQDGTTWYTHWGQGTLVTVSSASTKGPSGPSPVAALPPRTPPP

SEQ ID NO: 1396 - protein, 122 aa, Homo sapiens; identical to SEQ ID NO: 1390

SEQ ID NO: 1397 - protein, 134 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKPGDTAVYYCARDPQDGTTWYTHWGQGTLVTVSSASTKGPSGLPPGRP

SEQ ID NO: 1398 - protein, 123 aa, Homo sapiens
QVQLVQSGAEVKKPGASVKVSCKASGYSFSDYHIHWVRQAPGQGLEWMGWINQNGGGATHVQKFQGRVAMTRDTSISTAFMELSRLRFDDTAIYYCARALRPVADALELDYWGQGTLVTVSSA

SEQ ID NO: 1399 - protein, 130 aa, Homo sapiens
QVQLVQSGAEVKKPGASVKVSCKASGYIFNNYFLHWVRQAPGQGLEWMGWINPNTAGTNYAYNFRGRVSMTRDTSTGTAYMELSRLRSDDTAVYFCASCERGVVGVTTLGTGGYVRQWTSWGQGTHGRRL

SEQ ID NO: 1400 - protein, 122 aa, Homo sapiens
QVQLVQSGAEVKKPGASVKVSCKASGYSFSDYHIHWVRQAPGQGLEWMGWINQNGGGATHVQKFQGRVAMTRDTSISTAFMELSRLRFDDTAIYYCARALRPVADALELDYWGRGNAGHRLV

SEQ ID NO: 1401 - protein, 121 aa, Homo sapiens; identical to SEQ ID NO: 1391

SEQ ID NO: 1402 - protein, 136 aa, Homo sapiens
QVQLVQSGAEVKKPGASVKVSCKASGYTFTGYYMHWVRQAPGQGLEWMGWINPNSGGTNYAQKFQGRVTISTDESTATVYMELSSLRFEDTAIYYCARDRFYGSGSYVYWGQGTLVTVSSGSASAPTLSPRLLEFP

SEQ ID NO: 1403 - protein, 121 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKPGDTAVYYCARDPQDGTTWYTHWGQGTPVTVSSR

SEQ ID NO: 1404 - protein, 122 aa, Homo sapiens
QVQLVQSGAEAKKPGVSVKVSCKTSGYIFTGFYIHWVRQAPGQGLEWMGWINPKTGGANYAQKFQGRVTMTRDMPIRTIFMELSSLGSDDTAVYYCAREGGRLLVVRELQYWGQGTLVTVSS

SEQ ID NO: 1405 - protein, 125 aa, Homo sapiens
QVQLVQSGAEVKKPGASVKVSCKTSGYTFTDNYIHWVRQAPGQGLEWMGWINPNSGGSKSPQKFQGRVTMTRDTSVSTVYLELTRLKFDDTAIYYCTKDYGIVGSTLPEYFQHWGQGTLVTVSSA

SEQ ID NO: 1406 - protein, 125 aa, Homo sapiens
QVQLVQSGAEVKKPGASVKVSCKASGYTFTGYYMHWVRQAPGQGLEWMGWINPNSGGTNYAQKFQGRLTITADESTNTGYMELDNLRSDDTAIYYCARGRTVHPFEYYYYYMDVWGKGTTVTVTS

SEQ ID NO: 1407 - protein, 122 aa, Homo sapiens
QVQLVQSGAEVKKPGASVKVSCQASGYTFTDYYIHWLRQAPGQGLEWMGWINPNSGGAHYGLDYQGRVTMTGDTSITTVYMELTRLASDDTAIYYCAREGLCGTTSCQFDFWGQGTLVTVFS

SEQ ID NO: 1408 - protein, 123 aa, Homo sapiens
QVQLVQSGAEVKKPGASVKVSCKASGYSFSDYHIHWVRQAPGQGLEWMGWINQNGGGATHVQKFQGRVAMTRDTSISTAFMELSRLRFDDTAIYYCARALRPVADALELDYWGQGTLVTVSSG

SEQ ID NO: 1409 - protein, 124 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCTRDELFRVDDAFDMWGQGTRGHRLFSLH

SEQ ID NO: 1410 - protein, 161 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKPGDTAVYYCARDPQDGTTWYTHWGQGTLVTVSSASPRAHPVFPLAALPPGRTSETHSRPWAAWSRTTFPNRRCR

SEQ ID NO: 1411 - protein, 126 aa, Homo sapiens
QVQLVQSGSEVKKPGASVKVSCKASGYTFTTYYIHWVRQAPGQGLEWVGWFNPNSGGAHFGLDFQGRVTMTGDTSISTVYMDLTSLASVDTAIYYCAREGRCPTTSCHFDYWGQGTLVTVSSRLHQ

SEQ ID NO: 1412 - protein, 144 aa, Homo sapiens
QVQLVQSGVEVKKPGASMKVSCKASGYNFTGYFIHWVRQGPGQGLEWMGWMNPNTGGAKYAQKFQGRVTMTRDTSIRTAYMELSSLKPGDTAVYYCARDPQDGTTWYTHWGQGTLVTVSSRLHQGPIGPSPVAALPPRTPPPRR

SEQ ID NO: 1413 - protein, 123 aa, Homo sapiens
QVQLVQSGAEVKKPGSSVKVSCKASGYTFSAYYLHWVRQAPGQGLEWMGCINPNSGATIYAPKFQGRVTLTTDTSISTTFMEMSGLTYGDTAVYYCARNTDSVATSLYSLGVWGQGTTVTVSS

SEQ ID NO: 1414 - protein, 124 aa, Homo sapiens
QVQLVQSGAEVKKPGASVKVSCKTSGYSFTGNYIHWVRQAPGQGLEWMGWINPNSGGSKSPQKFQGRVTMTRDTSVSTVYLELTRLKFDDTAIYYCTKDYGIVGSTLPEYFQHWGQGTLVTVSS

SEQ ID NO: 1415 - protein, 137 aa, Homo sapiens
QVQLVQSGAEVKKPGASVKVSCKASRYTVTGYFIHWVRQAPGQGLEWMGWIKPNSESTNYAQKFQGRVTITADESTSTAYMELSSLRSEDTAVYYCASSRAAGGYYYYYMDVWGKGTTVTVSSGSASAPTLFPLVSS

SEQ ID NO: 1416 - protein, 135 aa, Homo sapiens
QVQLVQSGAAVKKPGSSVKVSCKASGGVFTKYDINWVRQGPWTRAVDGMDQPQWWHKLCTEISGAGSPPGTRPSPQPTWSAGHLTTRPYITVRACIVPRPLPCRGFDWGQGTLVTVSSGSASAPTLFPLVSSENS

SEQ ID NO: 1417 - protein, 118 aa, Homo sapiens
QVQLVQSGAEVKNLGASVKVSCKVSGHTLTDLSLHWVRQAPGKGLEWMGGFDPEDEETIYAQEFQGRIIMTEDTSTDTAYMELSSLRSHDTAVYYCAVSAYDTSLDYWGQGTLVTVSS

SEQ ID NO: 1418 - protein, 124 aa, Homo sapiens
QVQLVQSGAEVKKPGASVKVSCKTSGYSFTGNYIHWVRQAPGQGLEWMGWINPNSGGSKSPQKFQGRVTMTRDTSVSTVYLELTRLKFDDTAIYYCTKDYGMLGSTLPEYFQHWGQGTVVTVSS

SEQ ID NO: 1419 - protein, 114 aa, Homo sapiens
QVQLVQSGAEVKKPGASVKVSCKVSGYFLSKLSMHWVRQAPGKGLEWMGGFNPGEGETIYAQRFQGRVTITEDISTDTAYMELSSLRSEDTAVYFCATGITVVSVYLDYWGQGT

SEQ ID NO: 1420 - protein, 153 aa, Homo sapiens
QVQLVQSGAEMKKPGASVKVSCKTSGYTFTDYYFHWLRQAPGQGLEWMGWLVPNTGGTNYALNFQGRVAMTRDTSISTVYMELRRLRSDDTAVYYCVRDGGRRLGGSWYPNFDKWGQGTLITVSSASTKAHRSSPWHPPPRAPLGHSALGCLV

SEQ ID NO: 1421 - protein, 122 aa, Homo sapiens
QVQLVQSGAEVKKPGASVMVSCKASGYTFIDYYIYWVRQAPGRGLEWMGWINPNRGGTKYAQKFRDRVTMTRDTAVSTAYMELNSLRSDDTAVYYCARLQSLSGLYSNADYWGQGTLVTVSS

SEQ ID NO: 1422 - protein, 127 aa, Homo sapiens
QVQLVQSGAEVKKPGASVKVSCKASGYTFIDFYIHWVRQAPGQRLEWMGWFNPNTGGAHSGLDFQGRVTMTGDTSISTAYMELPRLASDDTAIYYCAREGHCRTTSCHFGFWGQGALVTVSSASTKA

SEQ ID NO: 1423 - protein, 123 aa, Homo sapiens
QVQLVQSGAEVKKPGASVKVSCKASGYTFSGYYYIHWVRQAPGQGLEWMGRINPNTGGTDYAQKFQGRVTMTRDTSMNTLYLELSRLTSDDTAVYYCATIQRLVKDLDYWGQGTLVTVSSAST

SEQ ID NO: 1424 - protein, 118 aa, Homo sapiens
QVQLVQSGVEVKKPGASVKVSCKVSGYFLSKISIHWVRQAPEKGLEWMGGFDAEQGETVYAQKFQGRVTVTEDTSTDTAYMDVSSLRSEDTAVYYCATGIRGRPLISWGQGTVVTVSS

SEQ ID NO: 1425 - protein, 124 aa, Homo sapiens
QVQLVQSGPEVKKPGASVKVSCKASGYTYNTYYMHWVRQAPGQGLEWMGWINPNSGGTNYAQRFQTRVDMTRGTSINTVYMELSGLTSDDTAVYYCVTDFNGGSSFSFYYFPTWGQGTRGHRLL

SEQ ID NO: 1426 - protein, 128 aa, Homo sapiens
QVQLVQSGAEVKKPGASVMVSCKASGYTFIDYYIYWVRQAPGRGLEWMGWINPNRGGTKYAQKFRDRVTMTRDTAVSTAYMELNSLRSDDTAVYYCARLQSLSGLYSNADYWGQGTLVTVSSRLHQRA

SEQ ID NO: 1427 - protein, 121 aa, Homo sapiens
QVQLVQSGAEVKKPGASVKVSCKISGYTFTKFYIHWVRQAPGQGLEWLGWINPNNGGTKSAQQFQGRVALTRDTSLSTAYIELSSLTSDDTAVYYCARGDYDYLWGNYRFEYWGQGTLVTV

SEQ ID NO: 1428 - protein, 126 aa, Homo sapiens
QVQLVQSGAEVKKPGASVKVSCQTSGYTSTGHYTHWVRQAPGQRPEWMGWMNPNSGGTTFAPKFQGRVTITRNTSISTAYMELSSLRSEDTAVYYCARGKWEQLGAFDIWGQGTMVTVSSGSASAP

SEQ ID NO: 1429 - protein, 124 aa, Homo sapiens
QVQLVQSGAEVKKPGASVKVSCQASGYTFTDYYIHWLRQAPGQGLEWMGWMNPNSGGTTFAPKFQGRITMTRDTSTSTAYLEVRGLRADDTAVYYCARDYCSGVSATTSLTPWGQGTLVHRLLT

SEQ ID NO: 1430 - protein, 124 aa, Homo sapiens
QVQLVQSGPEVKKPGASVKVSCKASGYTYNTYYMHWVRQAPGQGLEWMGWINPNSGGTNYAQRFQTRVDMTRDTSINTVYMELSGLTSDDTAVYYCVTDFNGGSSFPFTTLTTWGQGTLVTVSS

SEQ ID NO: 1431 - protein, 125 aa, Homo sapiens
QVQLVQSGAEVKKPGASVKVSCKASGYTFTDYFVHWVRQAPGQNFEWMGWTNVNTGGTKYAPKFQGRVTMTRDTSISTAYIELSGLTSDDTAVYYCARDMSSSWTNWYFDLWGPGTWSLSPQPPP

SEQ ID NO: 1432 - protein, 125 aa, Homo sapiens
QVQLVQSGAEVKKPGASVKVSCKASGYTYINYFMQWVRQAPGQGLEWMGWINPNSGLTNYAQKFRGRVTMARDTSINTAYMELRGLRIRHGRLLLYFLRPGWIVTIYKGGATYGMDVWGQGTTVT

SEQ ID NO: 1433 - protein, 128 aa, Homo sapiens
QVQLVQSGAEVKKPGASVKVSCETSGYTFSGFYLHWVRQAPGQGLEWVGWINPYSGGTDYAQKFQGRVTMTLDTSISTAYMELDGLRSDDTAILLLCERISTPIPRNSISLGRRFDPWGQGTLVIVSS

SEQ ID NO: 1434 - protein, 122 aa, Homo sapiens
QVQLVQSGAEVKKPGASVKVSCKASGYTFTDFYIRWVRQAPGQRLEWMGWFNPNTGGAHSGLDFQGRVTMTGDTSISTAYMELPRLASDDTAIYYCAREGHCRTTSCHFDFWGQGALVTVSS

SEQ ID NO: 1435 - protein, 121 aa, Homo sapiens
QVQLVQSGAEVRKPGASVRVSCKTSGYTFTGYYIHWVRQAPGQGLEWMGWINPDTGATKYSQKSQGRVSMTRDTSISTAYMELNRLMSDDTAFYYCARRPQDGSSWYTHWGQGTLVTVSTR

SEQ ID NO: 1436 - protein, 122 aa, Homo sapiens
QVQLVQSGAEVKKPGASVKVSCKASGYTFIDYYIYWVRQAPGQGLEWMGWINPNRGGTKYAQKFQGRVTLTRDTAVTTAYLEVNSLRSDDTAVYYCARLQSLHGFYSNADYWGQGTLVTVSS

SEQ ID NO: 1437 - protein, 122 aa, Homo sapiens
QVQLVQSGAEVKKPGSSVKVSCKASGYTFIDYYIYWVRQAPGQGLEWMGWINPNRGGTKYAQKFQGRVTLTRDTAVTTAYLEVNSLRSDDTAVYYCARLQSLHGFYSNADYWGQGTLVTVSS

SEQ ID NO: 1438 - protein, 138 aa, Homo sapiens
QVQLVQSGPEVRKPGASVKVSCEASGYTFTGYYIHWVRQAPGQGLEWMGWINPNNDGTTYAHKFQGRVTVTRDTSISTAYMELSGLRSDDTAIYYCARAPYSALYFYMDVWGKGTTVTVSSGSASAPTLFPLVSSENS

SEQ ID NO: 1439 - protein, 126 aa, Homo sapiens
QVQLVQSGAEVKKPGASVKVSCKTSGYSFTGNYIHWVRQAPGQGLEWMGWINPNSGGSKSPQKFQGRVTMTRDTSVSTVYMELTRLKFDDTAIYYCTKDYGMLGSTLPEYFQHWGQGTLVTVSSRL

SEQ ID NO: 1440 - protein, 131 aa, Homo sapiens
QVQLVQSGAEVKKPGASVKVSCKASGYIFNNYFLHWVRQAPGQGLEWMGWINPNTAGTNYAYNFRGRVSMTRDTSTGTAYMELSRLRSDDTAVYFCASCERVVVGVTTLGRGGLRTPWTSWGQGTTVAVSS

SEQ ID NO: 1441 - protein, 140 aa, Homo sapiens
QVQLVQSGAEVKNPGASVKVSCKTSGYTFTVHYIHWVRQAPGQGLEWMGWINPNSGDTDYAQKFQGRVTMTRDTPINAAYLDLSRLRSDDTAVYYCARDRYYDSSGYPDAFDIWGQGTMVTVSSGSASAQPFPLVSSENS

SEQ ID NO: 1442 - protein, 124 aa, Homo sapiens
QVQLVQSGAEVKKPGASVMVSCKASGYTFIDYYIYWVRQAPGQGLEWMGWINPNRGGTKYAQKFQGRVTLTRDTAVTTAYLEVNSLRSDDTAVYYCARLQSLHGFYSNADYWGQGTLVTVSSRL

SEQ ID NO: 1443 - protein, 132 aa, Homo sapiens
QVQLVQSGAEVKKPGASVKVSCKASGYSFTTYSIYWVRQAPGQGPEWMGWISPNSGGTNYAQKFQGRVTMTRDTSINTAYMDLTRLTSDDTAMYYCTARPITGSAFDIWGQGTMVSVSSGMHPAQPFSPRLL

SEQ ID NO: 1444 - protein, 136 aa, Homo sapiens
QVQLVQSGAEVKKPGASVKVSCKASGYSFTTYSIYWVRQAPGQGPEWMGWINPNSGGTNYAQKFQGRVTMTGDTSINTAYMDLTRLTSDDTAMYYCTARPITGSAFDIWGQGTMVSVSSGSASAPTLFPSSPLRIP

SEQ ID NO: 1445 - protein, 121 aa, Homo sapiens
QVQLVQSGAEVKKPGASVMVSCKASGYTFIDYYIYWVRQAPGQGLEWMGWINPNRGGTKYAQKFQGRVTLTRDTAVTTAYLEVNSLRSDDTAVYYCARLQSLHGFYNADYWGQGTLVTVAS

SEQ ID NO: 1446 - protein, 160 aa, Homo sapiens
QVQLVQSGAEVKKPGASVMVSCKASGYTFIDYYIYWVRQAPGQGLEWMGWINPNRGGTKYAQKFQGRVTLTRDTAVTTAYLEVNSLRSDDTAVYYCARLQSLHGFYSNADYWGQGTLVTVSSASTKAHRSSPWHPPPRRTSGAQQPWAAWSRTTPEPVTV

SEQ ID NO: 1447 - protein, 115 aa, Homo sapiens
QVQLVQSGAEVKKPGASVKVSCQGSGYTFTDYYINWVRQAPGQGLEWMGWINSNSGGTSYAQKFQGRVTMTRDTSISTVYMELSGLTSDDTAVYYCARVSPPDVWGKGTTVTVSS

SEQ ID NO: 1448 - protein, 123 aa, Homo sapiens
QVQLVQSGAEVKKPGASVRVSCKASGYILSAYSMHWVRQAPGQGLEWMGWIKANSDGTNYAQKFFGRVTMTRDTSSSTAYMELTGLRSDDTAIYYCARAYGSYAEYCLHWGQGTLVTVSSRLH

SEQ ID NO: 1449 - protein, 123 aa, Homo sapiens
QVQLVQSGAEVKKPGASVKVSCQGSGYTFTDYYINWVRQAPGQGLEWMGWINSNSGGTSYAQKFQGRVTMTRDTSISTVYMELSGLTSDDTAVYYCARVSPPDVWGKGPRSPSLQPPPRPIGL

SEQ ID NO: 1450 - protein, 138 aa, Homo sapiens
QVQLVQSGAEVKKPGASVMVSCKASGYTFIDYYIYWVRQAPGQGLEWMGWINPNRGGTKYAQKFQGRVTLTRDTAVTTAYLEVNSLRSDDTAVYYCARLQSLHGFYSNADYWGQGTLVTVSSASTNGPIGLPPGHPPP

SEQ ID NO: 1451 - protein, 120 aa, Homo sapiens
QVQLVQSGAEVKKPGASVKVSCKASGYTFSGYYYIHWVRQAPGQGLEWMGRINPNTGGTDYAQKFQGRVTMTRDTSMNTLYLELSRLTSDDTAVYYCATIQRLVKDLDYWGQGTRGHRLL

SEQ ID NO: 1452 - protein, 121 aa, Homo sapiens
QVQLVQSGPEVKKPGASVKVSCKASGYTYNTYYMHWVRQAPGQGLEWMGWINPNSGGTNYAQRFQTRVDMTRDTSINTVYMELSGLTSDDTAVYYCVTDFERGYRFSTTWTSWGKGPRSSS

SEQ ID NO: 1453 - protein, 118 aa, Homo sapiens
QVQLVQSGAEVKKPGASVKVSCKASGYSFTGQYIHWVRQAPGQGLEWMGMINCNNGGTKIAQKFQGRVTLTRDTSISTAYMELSSLRSDDLAVYFCTRAIVGSEGDFWGQGTLVTVSS

SEQ ID NO: 1454 - protein, 125 aa, Homo sapiens
QVQLVQSGPEVKKPGASVKVSCKASGYTYNTYYMHWVRQAPGQGLEWMGWINPNSGGTNYAQRFQTRVDMTRDTSINTVYMELSGLTSDDTAVYYCVTDFNGGVFLYYFDHWGQGTLVTVSSAST

SEQ ID NO: 1455 - protein, 121 aa, Homo sapiens
QVQLVQSGAEMKKPGASVKVSCKSTGYSLTGYYMHWVRQAPGQGLEWMGWINPNNGATNYAQKFHDRVTMTRDTSISAVYMELNRLKSEDTAMLFLCETHGTPPLLFLTTWGQGTLVAVSS

SEQ ID NO: 1456 - protein, 120 aa, Homo sapiens
QVQLVQSGAEVKKPGASVKVSCQASGYTITTYDFNWVRQAPGQGLEWMGWINPHSGGTNYAQHFQGRVTMTRDTSINTVYMDLSRLTSDDTVLLFCARDNNWDRRQLVRPWGQGTLVTVS

SEQ ID NO: 1457 - protein, 119 aa, Homo sapiens
QVQLVQSGAEVKKPGASVKVSCKASGYIFAGYYMEWVRQTPGQGLEWMGWIDPRSGGTNYAQKFQGRVTLTRDTSLRTAYMELSSLRSDDTAVYYCATDNGSGIFWGKGTVVTVSAAST

SEQ ID NO: 1458 - protein, 126 aa, Homo sapiens
QVQLVQSGAEVKKPGASVKVSCKASGYSFSDYHIHWVRQAPGQGLEWMGWINQNGWWRNDMYRSSRAGSPPGDTSISTAFMELSRLRFDDTAIYYCARDYYDVLTTYSHYFFDLWGQGTLVTVIRG

SEQ ID NO: 1459 - protein, 123 aa, Homo sapiens
QVQLVQSGAEVKKPGASVKVSCKASGYTFTGYYMHWVRQAPGQGLEWMGWINPNSGGTNYAQKFQDRVTFTTDESKTTAYMELSSLRSEDSAVYYCAINTDSVATSLYSLGVWGQGTTVTVSS

We claim:

1. An isolated human monoclonal antibody comprising:
a heavy chain comprising a heavy chain variable region comprising a heavy chain complementarity determining region (HCDR) 1, a HCDR2 and a HCDR3, and a light chain comprising a light chain variable region comprising a light chain complementarity determining region (LCDR) 1, a LCDR2 and a LCDR3, wherein
the HCDR1, HCDR2, and HCDR3 comprise amino acids 26-33, 51-58, and 97-110 of SEQ ID NO: 1, respectively; and
the LCDR1, LCDR2, and LCDR3 comprise amino acids 27-30, 48-50, and 87-91 of SEQ ID NO: 2, respectively, and
the antibody specifically binds to a CD4 binding site on the surface of gp120 and neutralizes HIV-1.

2. The isolated human monoclonal antibody of claim 1, wherein the antibody binds resurfaced stabilized core (RSC) 3 with a $K_D$ of $10^{-8}$ or less.

3. The isolated human monoclonal antibody of claim 1, wherein the antibody specifically binds to residues 276, 278-283, 365-368, 371, 455-459, 461, 469 and 472-474 of gp120 according to the HXB2 numbering system.

4. The isolated human monoclonal antibody of claim 1, wherein the isolated human monoclonal antibody neutralizes over 90% of Human Immunodeficiency Virus 1 (HIV-1) isolates listed in FIGS. 16-24 with an $IC_{50}$ value of less than 50 µg/ml.

5. The isolated human monoclonal antibody of claim 1, wherein the heavy chain variable region of the antibody comprises the amino acid sequence set forth as SEQ ID NO: 1.

6. The isolated human monoclonal antibody of claim 1, wherein the light chain of the antibody comprises SEQ ID NO: 2 or SEQ ID NO: 4.

7. The isolated human monoclonal antibody of claim 1, wherein the heavy chain of the antibody comprises SEQ ID NO: 1 and the light chain of the antibody comprises SEQ ID NO: 2.

8. The isolated human monoclonal antibody of claim 1, wherein the antibody is an IgG, IgM or IgA.

9. A functional fragment of the isolated human monoclonal antibody of claim 1, wherein the functional fragment specifically binds to the CD4 binding site on the surface of gp120 and neutralizes HIV-1.

10. The functional fragment of claim 9, wherein the fragment is a Fab fragment, a Fab' fragment, a F(ab)'$_2$ fragment, a single chain Fv protein (scFv), or a disulfide stabilized Fv protein (dsFv).

11. The isolated human monoclonal antibody of claim 1, or a functional fragment thereof, wherein the antibody is labeled, wherein the functional fragment specifically binds to the CD4 binding site on the surface of gp120 and neutralizes HIV-1.

12. A method of detecting a human immunodeficiency virus (HIV) 1 in a subject comprising:
contacting a biological sample from the subject with at least one isolated human monoclonal antibody of claim 1 or a functional fragment thereof, wherein the functional fragment specifically binds to the CD4 binding site on the surface of gp120 and neutralizes HIV-1 and
detecting the antibody or functional fragment bound to the sample,
wherein the presence of antibody bound to the sample indicates that the subject has HIV-1.

13. A composition, comprising:
a pharmaceutically acceptable carrier; and
the isolated human monoclonal antibody of claim 1, or a functional fragment thereof, wherein the functional fragment specifically binds to the CD4 binding site on the surface of gp120 and neutralizes HIV-1.

14. The composition of claim 13, wherein the antibody binds resurfaced stabilized core (RSC) 3 with a $K_D$ of $10^{-8}$ or less.

15. The composition of claim 13, wherein the antibody specifically binds to residues 276, 278-283, 365-368, 371, 455-459, 461, 469 and 472-474 of gp120 according to the HXB2 numbering system.

16. The composition of claim 13, wherein the isolated human monoclonal antibody neutralizes over 90% of Human Immunodeficiency Virus 1 (HIV-1) isolates listed in FIGS. 16-24 with an $IC_{50}$ value of less than 50 µg/ml.

17. The composition of claim 13, wherein the heavy chain variable region of the antibody comprises the amino acid sequence set forth as SEQ ID NO: 1.

18. The composition of claim 13, wherein the light chain of the antibody comprises SEQ ID NO: 2 or SEQ ID NO: 4.

19. The composition of claim 13, wherein the heavy chain of the antibody comprises SEQ ID NO: 1 and the light chain of the antibody comprises SEQ ID NO: 2.

20. The composition of claim 13, wherein the antibody is an IgG, IgM or IgA.

21. The composition of claim 13, wherein the functional fragment is a Fab fragment, a Fab' fragment, a F(ab)'$_2$ fragment, a single chain Fv protein (scFv), or a disulfide stabilized Fv protein (dsFv).

22. The composition of claim 13, wherein the antibody or functional fragment is labeled.

23. A method of detecting a human immunodeficiency virus (HIV) 1 in a subject comprising:
contacting a biological sample from the subject with the composition of claim 13; and
detecting the antibody or functional fragment thereof bound to the sample;
wherein the presence of antibody or functional fragment bound to the sample indicates that the subject has HIV-1.

* * * * *